US010982223B2

(12) United States Patent
Gray et al.

(10) Patent No.: US 10,982,223 B2
(45) Date of Patent: Apr. 20, 2021

(54) INCREASING PLANT GROWTH AND YIELD BY USING A PHENYLALANINE AMMONIA LYASE SEQUENCE

(71) Applicant: BENSON HILL, INC., St. Louis, MO (US)

(72) Inventors: Benjamin Neil Gray, Chapel Hill, NC (US); Henry D. Priest, Hazelwood, MO (US)

(73) Assignee: Benson Hill, Inc., St. Louis, MO (US)

( * ) Notice: Subject to any disclaimer, the term of this patent is extended or adjusted under 35 U.S.C. 154(b) by 0 days.

(21) Appl. No.: 16/308,993

(22) PCT Filed: Jun. 12, 2017

(86) PCT No.: PCT/IB2017/053467
§ 371 (c)(1),
(2) Date: Dec. 11, 2018

(87) PCT Pub. No.: WO2017/216704
PCT Pub. Date: Dec. 21, 2017

(65) Prior Publication Data
US 2020/0149058 A1 May 14, 2020

Related U.S. Application Data

(60) Provisional application No. 62/349,313, filed on Jun. 13, 2016.

(51) Int. Cl.
C12N 15/82 (2006.01)
C07K 14/415 (2006.01)

(52) U.S. Cl.
CPC ........ C12N 15/8261 (2013.01); C07K 14/415 (2013.01)

(58) Field of Classification Search
CPC .................. C12N 15/8261; Y02A 40/146
See application file for complete search history.

(56) References Cited

U.S. PATENT DOCUMENTS 5,510,474 A * 4/1996 Quail ................... C07K 14/415
435/320.1
8,927,808 B2 * 1/2015 Rommens ................ A01H 5/04
800/279
2011/0167514 A1 7/2011 Brover et al.

FOREIGN PATENT DOCUMENTS

WO     WO 03/000906 A2    1/2003
WO     WO 2011/015985 A2  2/2011
WO     WO 2012/103555 A2  8/2012
WO     WO-2012103555 A2 * 8/2012 ......... C12N 15/8255

OTHER PUBLICATIONS

Elkind et al (Abnormal plant development and down-regulation of phenylpropanoid biosynthesis in transgenic tobacco containing a heterologous phenylalanine ammonia-lyase gene. PNAS. 87, pp. 9057-9061, 1990) (Year: 1990).*
Cass et al (Effects of Phenylalanine Ammonia Lyase (PAL) knock-down on cell wall composition, biomass digestibility, and biotic and abiotic stress responses in Brachypodium. Journal of Experimental Botany, vol. 66, No. 14 pp. 4317-4335, 2015) (Year: 2015).*
Boudet, Alain-Michel, "Evolution and current status of research in phenolic compounds," *Phytochemistry*, 2007, vol. 68(22-24), pp. 2722-2735.
Howles, P., et al., "Overexpression of L-Phenylalanine Ammonia-Lyase in Transgenic Tobacco Plants Reveals Control Points for Flux into Phenylpropanoid Biosynthesis," *Plant Physiol*, 1996, vol. 112(4), pp. 1617-1624.
Meyer, J., et al., "Signals that stop the rot: Regulation of secondary metabolite defences in cereals," *Physiological and Molecular Plant Pathology*, 2015, vol. 94, pp. 156-166.

* cited by examiner

*Primary Examiner* — Ashley K Buran
*Assistant Examiner* — Wayne Zhong
(74) *Attorney, Agent, or Firm* — Womble Bond Dickinson (US) LLP

(57) ABSTRACT

Compositions and methods for improving plant growth are provided herein. Polynucleotides encoding phenylalanine ammonia lyase (PAL) proteins, polypeptides encompassing PAL proteins, and expression constructs for expressing genes of interest whose expression may improve agronomic properties including but not limited to crop yield, biotic and abiotic stress tolerance, and early vigor, plants comprising the polynucleotides, polypeptides, and expression constructs, and methods of producing transgenic plants are also provided.

9 Claims, No Drawings
Specification includes a Sequence Listing.

INCREASING PLANT GROWTH AND YIELD BY USING A PHENYLALANINE AMMONIA LYASE SEQUENCE

CROSS-REFERENCE TO RELATED APPLICATIONS

This application is a national stage filing under 35 U.S.C. 371 of PCT/IB2017/053467 filed Jun. 12, 2017, which International Application was published by the International Bureau in English on Dec. 21, 2017, and claims priority from U.S. Provisional Application No. 62/349,313, filed Jun. 13, 2016 which applications are hereby incorporated by reference in their entirety in this application.

FIELD OF THE INVENTION

The invention is drawn to compositions and methods for increasing plant growth and yield through expression of a phenylalanine ammonia lyase gene in a plant.

BACKGROUND OF THE INVENTION

The ever-increasing world population and the dwindling supply of arable land available for agriculture fuels research towards developing plants with increased biomass and yield. Conventional means for crop and horticultural improvements utilize selective breeding techniques to identify plants having desirable characteristics. However, such selective breeding techniques have several drawbacks, namely that these techniques are typically labor intensive and result in plants that often contain heterogeneous genetic components that may not always result in the desirable trait being passed on from parent plants. Advances in molecular biology provide means to modify the germplasm of plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

Traits of interest include plant biomass and yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigor may also be important factors in determining yield. Optimizing the abovementioned factors may therefore contribute to increasing crop yield.

An increase in seed yield is a particularly important trait since the seeds of many plants are important for human and animal consumption. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain. An increase in plant biomass is important for forage crops like alfalfa, silage corn and hay. Many genes are involved in plant growth and development. Modulating the expression of one or more such genes in a plant can produce a plant with improved growth and development relative to a control plant, but often can produce a plant with impaired growth and development relative to a control plant. Therefore, methods to improve plant growth and development are needed.

SUMMARY OF THE INVENTION

Compositions and methods for regulating gene expression in a plant are provided. The methods increase plant growth resulting in higher crop yield. Such methods include increasing the expression of at least one phenylalanine ammonia lyase (PAL) gene in a plant of interest. The invention also emcompasses contructs comprising a promoter that drives expression in a plant cell operably linked to a PAL coding sequence. Compositions further comprise plants, plant seeds, plant organs, plant cells, and other plant parts that have increased expression of a PAL sequence. The invention includes methods that can be utilized to increase expression of a PAL gene in a plant. Such PAL gene may be a native sequence or alternatively, may be a sequence that is heterologous to the plant of interest.

Embodiments of the invention include:
1. A method for increasing crop yield comprising transforming a plant with at least one PAL protein-encoding sequence.
2. The method of embodiment 1, wherein said PAL protein-encoding sequence comprises SEQ ID NO:1, or encodes a protein selected from the group consisting of SEQ ID NOs: 2 and 14-115.
3. The method of embodiment 1, wherein said PAL protein-encoding sequence encodes a protein with at least 80%, 90%, 95%, 96%, 97%, 98%, or 99% sequence identity to a sequence selected from the group consisting of SEQ ID NOs: 2 and 14-115, and that has PAL enzyme activity.
4. The method of embodiment 1, wherein said PAL protein-encoding sequence encodes a protein with at least 80%, 85%, 90%, 95%, 96%, 97%, 98%, or 99% sequence positives relative to a sequence selected from the group consisting of SEQ ID NOs: 2 and 14-115, and that has PAL enzyme activity.
5. A plant having stably incorporated into its genome a promoter that drives expression in a plant operably linked to a PAL protein-encoding sequence, wherein said promoter is heterologous to said PAL protein-encoding sequence.
6. The plant of embodiment 5, wherein said PAL protein-encoding sequence comprises SEQ ID NO:1, or encodes a protein selected from the group consisting of SEQ ID NOs: 2 and 14-115.
7. The plant of embodiment 5, wherein said PAL protein-encoding sequence encodes a protein with at least 80%, 85%, 90%, 95%, 96%, 97%, 98%, or 99% sequence identity to a sequence selected from the group consisting of SEQ ID NOs: 2 and 14-115, and that has PAL enzyme activity.
8. The plant of embodiment 5, wherein said PAL protein-encoding sequence encodes a protein with at least 80%, 85%, 90%, 95%, 96%, 97%, 98%, or 99% sequence positives relative to a sequence selected from the group consisting of SEQ ID NOs: 2 and 14-115, and that has PAL enzyme activity.

9. Transformed seed of any one of the plants of embodiments 5-8.

10. The plant of any one of embodiments 5-8 wherein said plant is a monocot.

11. The plant of embodiment 10 wherein said plant is from the genus *Zea, Oryza, Triticum, Sorghum, Secale, Eleusine, Setaria, Saccharum, Miscanthus, Panicum, Pennisetum, Megathyrsus, Cocos, Ananas, Mus*a, *Elaeis, Avena*, or *Hordeum*.

12. The plant of any one of embodiments 5-8 wherein said plant is a dicot.

13. The plant of embodiment 12 wherein said plant is from the genus Glycine, *Brassica, Medicago, Helianthus, Carthamus, Nicotiana, Solanum, Gossypium, Ipomoea, Manihot, Coffea, Citrus, Theobroma, Camellia, Persea, Ficus, Psidium, Mangifera, Olea, Carica, Anacardium, Macadamia, Prunus, Beta, Populus*, or *Eucalyptus*.

14. The plant of any one of embodiments 5-8 wherein said plant exhibits increased growth relative to a control plant.

15. The plant of any one of embodiments 5-8 wherein said plant exhibits increased biomass yield relative to a control plant.

16. The plant of any one of embodiments 5-8 wherein said plant exhibits increased seed yield relative to a control plant.

17. The method of any one of embodiments 1-4, wherein said PAL protein-encoding sequence is expressed from a constitutive promoter.

18. The method of embodiment 17, wherein said constitutive promoter is selected from the group of SEQ ID NOs: 3 and 5.

19. The method of any one of embodiments 1-4, wherein said PAL protein-encoding sequence is expressed from a bundle sheath-preferred promoter.

20. The method of embodiment 19, wherein said bundle sheath-preferred promoter is selected from the group of SEQ ID NOs: 7 and 13.

21. The method of any one of embodiments 1-4, wherein said PAL protein-encoding sequence is expressed from a mesophyll-preferred promoter.

22. The method of embodiment 21, wherein said mesophyll-preferred promoter is selected from the group of SEQ ID NOs: 9 and 11.

23. The plant of any one of embodiments 5-8, wherein said promoter that drives expression in a plant is a constitutive promoter.

24. The plant of embodiment 23, wherein said constitutive promoter is selected from the group of SEQ ID NOs: 3 and 5.

25. The plant of any one of embodiments 5-8, wherein said promoter that drives expression in a plant is a bundle sheath-preferred promoter.

26. The plant of embodiment 25, wherein said bundle sheath-preferred promoter is selected from the group of SEQ ID NOs: 7 and 13.

27. The plant of any one of embodiments 5-8, wherein said promoter that drives expression in a plant is a mesophyll-preferred promoter.

28. The plant of embodiment 27, wherein said mesophyll-preferred promoter is selected from the group of SEQ ID NOs: 9 and 11.

29. A DNA construct comprising, in operable linkage,
   a. A promoter that is functional in a plant cell and,
   b. A nucleic acid sequence encoding a PAL protein.

30. The DNA construct of embodiment 29, wherein said nucleic acid sequence encoding a PAL protein comprises SEQ ID NO: 1, or encodes a protein selected from the group consisting of SEQ ID NOs: 2 and 14-115.

31. The DNA construct of embodiment 29 or 30, wherein said nucleic acid sequence encoding a PAL protein encodes a protein with at least 80%, 85%, 90%, 95%, 96%, 97%, 98%, or 99% sequence identity to a sequence selected from the group consisting of SEQ ID NOs: 2 and 14-115, and that has PAL enzyme activity.

32. The DNA construct of embodiment 29 or 30, wherein said nucleic acid sequence encoding a PAL protein encodes a protein with at least 80%, 85%, 90%, 95%, 96%, 97%, 98%, or 99% sequence positives relative to a sequence selected from the group consisting of SEQ ID NOs: 2 and 14-115, and that has PAL enzyme activity.

33. The DNA construct of embodiment 29 or 30, wherein said promoter that is functional in a plant cell is selected from the group of SEQ ID NOs: 3, 5, 7, 9, 11, and 13.

34. The DNA construct of any one of embodiments 29-33, wherein said promoter is heterologous to said nucleic acid sequence encoding a PAL protein.

35. A method for increasing crop yield comprising modulating the expression of at least one PAL protein-encoding sequence in a plant.

36. The method of embodiment 35 wherein said modulating the expression comprises increasing the expression of at least one PAL protein-encoding sequence in a plant.

37. The method of embodiment 36, wherein said increasing the expression comprises increasing the activity of a native PAL sequence in said plant or increasing activity of a native PAL protein-encoding sequence in said plant.

38. The method of any one of embodiments 1-4, further comprising transforming a plant with at least one additional coding sequence.

39. The method of embodiment 38 wherein said additional coding sequence shares at least 70% identity with a sequence selected from the group of SEQ ID NOs: 116, 120, 123, and 126, or encodes a protein that shares at least 80% identity with a sequence selected from the group of SEQ ID NOs:117, 121, 124, and 127.

40. The method of embodiment 39 wherein said additional coding sequence comprises a sequence selected from the group of SEQ ID NOs:116, 120, 123, and 126, or encodes a protein that comprises a sequence selected from the group of SEQ ID NOs:117, 121, 124, and 127.

41. The plant of any one of embodiments 5-8, wherein said plant has stably incorporated into its genome a second promoter that drives expression of at least one additional coding sequence, wherein said second promoter is heterologous to said additional coding sequence.

42. The plant of embodiment 41 wherein said additional coding sequence shares at least 70% identity with a sequence selected from the group of SEQ ID NOs:116, 120, 123, and 126, or encodes a protein that shares at least 80% identity with a sequence selected from the group of SEQ ID NOs:117, 121, 124, and 127.

43. The plant of embodiment 42 wherein said additional coding sequence comprises a sequence selected from the group of SEQ ID NOs:116, 120, 123, and 126, or encodes a protein that comprises a sequence selected from the group of SEQ ID NOs:117, 121, 124, and 127.
44. Transformed seed of any one of the plants of embodiments 41-43.
45. The DNA construct of any one of embodiments 29-34 further comprising, in operable linkage,
    a. a second promoter that is functional in a plant cell and,
    b. an additional coding sequence, wherein said second promoter is heterologous to said additional coding sequence.
46. The DNA construct of embodiment 45 wherein said additional coding sequence shares at least 70% identity with a sequence selected from the group of SEQ ID NOs:116, 120, 123, and 126, or encodes a protein that shares at least 80% identity with a sequence selected from the group of SEQ ID NOs:117, 121, 124, and 127.
47. The DNA construct of embodiment 46 wherein said additional coding sequence comprises a sequence selected from the group of SEQ ID NOs:116, 120, 123, and 126, or encodes a protein that comprises a sequence selected from the group of SEQ ID NOs:117, 121, 124, and 127.

DETAILED DESCRIPTION OF THE INVENTION

Compositions and methods for increasing crop biomass and yield are provided. The methods include increasing the expression of at least one phenylalanine ammonia lyase (PAL) gene in a plant of interest. Crop yield is an extremely complex trait that results from the growth of a crop plant through all stages of its development and allocation of plant resources to the harvestable portions of the plant. In some crops including but not limited to maize and soybean, the primary harvestable portions may include seeds, with secondary applications from the remainder of the biomass (e.g., leaves and stems). In other crops including but not limited to sugarcane and alfalfa, the primary harvestable portions of the plant consist of the stems or entire above-ground portion of the plant. In other crops including but not limited to potato and carrot, the primary harvestable portions of the plant are found below-ground. Regardless of the harvested portion(s) of the crop plant, the accumulation of harvestable biomass results from plant growth and allocation of photosynthetically fixed carbon to the harvested portion(s) of the plant. Plant growth may be manipulated by modulating the expression of one or more plant genes. This modulation can alter the function of one or more metabolic pathways that contributes to plant growth and accumulation of harvestable biomass.

Methods of the invention include the manipulation of plant growth for increased yield through modulation of the expression of one or more genes encoding a phenylalanine ammonia lyase (PAL) protein. In a preferred embodiment, the expression of a PAL-encoding gene is upregulated relative to PAL expression levels in a control plant, resulting in increased harvestable biomass in plants with increased PAL expression relative to control plants. Any methods for increasing the activity or expression of a PAL-encoding sequence in a plant are encompassed by the present invention.

The compositions of the invention include constructs comprising the coding sequence set forth in SEQ ID NO: 1 or encoding a protein selected from the group of SEQ ID NOs: 2 and 14-115 or variants thereof, operably linked to a promoter that is functional in a plant cell. By "promoter" is intended to mean a regulatory region of DNA that is capable of driving expression of a sequence in a plant or plant cell. It is recognized that having identified the PAL protein sequences disclosed herein, it is within the state of the art to isolate and identify additional PAL protein sequences and nucleotide sequences encoding PAL protein sequences, for instance through BLAST searches, PCR assays, and the like.

The coding sequences of the present invention, when assembled within a DNA construct such that a promoter is operably linked to the coding sequence of interest, enable expression and accumulation of PAL protein in the cells of a plant stably transformed with this DNA construct. "Operably linked" is intended to mean a functional linkage between two or more elements. For example, an operable linkage between a promoter of the present invention and a heterologous nucleotide of interest is a functional link that allows for expression of the heterologous nucleotide sequence of interest. Operably linked elements may be contiguous or non-contiguous. When used to refer to the joining of two protein coding regions, by operably linked is intended that the coding regions are in the same reading frame. The cassette may additionally contain at least one additional gene to be co-transformed into the plant. Alternatively, the additional gene(s) can be provided on multiple expression cassettes or DNA constructs. The expression cassette may additionally contain selectable marker genes.

In this manner, the nucleotide sequences encoding the PAL proteins of the invention are provided in expression cassettes or expression constructs along with a promoter sequence of interest, typically a heterologous promoter sequence, for expression in the plant of interest. By "heterologous promoter sequence" is intended to mean a sequence that is not naturally operably linked with the PAL protein-encoding nucleotide sequence. While the PAL-encoding nucleotide sequence and the promoter sequence are heterologous to each other, either the PAL-encoding nucleotide sequence or the heterologous promoter sequence may be homologous, or native, or heterologous, or foreign, to the plant host. It is recognized that the promoter may also drive expression of its homologous or native nucleotide sequence. In this case, the transformed plant will have a change in phenotype.

Fragments and variants of the polynucleotides and amino acid sequences of the present invention may also be expressed by promoters that are operable in plant cells. By "fragment" is intended a portion of the polynucleotide or a portion of the amino acid sequence. "Variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. As used herein, a "native" polynucleotide or polypeptide comprises a naturally occurring nucleotide sequence or amino acid sequence, respectively. Generally, variants of a particular polynucleotide of the invention will have at least about 75%, 80%, 85%, 90%, 91%, 92%, 93%, 94%, 95%, 96%, 97%, 98%, 99% or more sequence identity to that particular polynucleotide as determined by sequence alignment programs and parameters as described elsewhere herein. Fragments and variants of the polynucleotides disclosed herein can encode proteins with PAL activity.

"Variant" amino acid or protein is intended to mean an amino acid or protein derived from the native amino acid or protein by deletion (so-called truncation) of one or more amino acids at the N-terminal and/or C-terminal end of the native protein; deletion and/or addition of one or more amino acids at one or more internal sites in the native protein; or substitution of one or more amino acids at one or more sites in the native protein. Variant proteins encompassed by the present invention are biologically active, that is they continue to possess the desired biological activity of the native protein, such as PAL activity. Biologically active variants of a native polypeptide will have at least about 80%, 85%, 90%, 91%, 92%, 93%, 94%, 95%, 96%, 97%, 98%, 99% or more sequence identity to the amino acid sequence for the native sequence as determined by sequence alignment programs and parameters described herein. In some embodiments, the variant polypeptide sequences will comprise conservative amino acid substitutions. The number of such conservative amino acid substitutions, summed with the number of amino acid identities, can be used to calculate the sequence positives when this sum is divided by the total number of amino acids in the sequence of interest. Sequence positive calculations are performed on the NCBI BLAST server that can be accessed on the world wide web at blast.ncbi.nlm.nih.gov/Blast.cgi. A biologically active variant of a protein of the invention may differ from that protein by as few as 1-15 amino acid residues, as few as 1-10, such as 6-10, as few as 5, as few as 4, 3, 2, or even 1 amino acid residue.

Amino acids can be generally categorized as aliphatic, hydroxyl or sulfur/selenium-containing, cyclic, aromatic, basic, or acidic and their amide. Without being limited by theory, conservative amino acid substitutions may be preferable in some cases to non-conservative amino acid substitutions for the generation of variant protein sequences, as conservative substitutions may be more likely than non-conservative substitutions to allow the variant protein to retain its biological activity. Polynucleotides encoding a polypeptide having one or more amino acid substitutions in the sequence are contemplated within the scope of the present invention. Table 1 below provides a listing of examples of amino acids belong to each class.

TABLE 1

Classes of Amino Acids

| Amino Acid Class | Example Amino Acids |
| --- | --- |
| Aliphatic | Gly, Ala, Val, Leu, Ile |
| Hydroxyl or sulfur/selenium-containing | Ser, Cys, Thr, Met, Sec |
| Cyclic | Pro |
| Aromatic | Phe, Tyr, Trp |
| Basic | His, Lys, Arg |
| Acidic and their Amide | Asp, Glu, Asn, Gln |

Variant sequences may also be identified by analysis of existing databases of sequenced genomes. In this manner, corresponding sequences can be identified and used in the methods of the invention.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) CABIOS 4:11-17; the local alignment algorithm of Smith et al. (1981) Adv. Appl. Math. 2:482; the global alignment algorithm of Needleman and Wunsch (1970) J. Mol. Biol. 48:443-453; the search-for-local alignment method of Pearson and Lipman (1988) Proc. Natl. Acad. Sci. 85:2444-2448; the algorithm of Karlin and Altschul (1990) Proc. Natl. Acad. Sci. USA 87:2264-2268, modified as in Karlin and Altschul (1993) Proc. Natl. Acad. Sci. USA 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) Gene 73:237-244 (1988); Higgins et al. (1989) CABIOS 5:151-153; Corpet et al. (1988) Nucleic Acids Res. 16:10881-90; Huang et al. (1992) CABIOS 8:155-65; and Pearson et al. (1994) Meth. Mol. Biol. 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et al (1990) J. Mol. Biol. 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) Nucleic Acids Res. 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See www.ncbi.nlm.nih.gov. Alignment may also be performed manually by inspection.

Such genes and coding regions can be codon optimized for expression in a plant of interest. A "codon-optimized gene" is a gene having its frequency of codon usage designed to mimic the frequency of preferred codon usage of the host cell. Nucleic acid molecules can be codon optimized, either wholly or in part. Because any one amino acid (except for methionine and tryptophan) is encoded by a number of codons, the sequence of the nucleic acid molecule may be changed without changing the encoded amino acid. Codon optimization is when one or more codons are altered at the nucleic acid level such that the amino acids are not changed but expression in a particular host organism is increased. Those having ordinary skill in the art will recognize that codon tables and other references providing preference information for a wide range of organisms are available in the art (see, e.g., Zhang et al. (1991) Gene 105:61-72; Murray et al. (1989) Nucl. Acids Res. 17:477-508). Methodology for optimizing a nucleotide sequence for expression in a plant is provided, for example, in U.S. Pat.

No. 6,015,891, and the references cited therein, as well as in WO 2012/142,371, and the references cited therein.

The nucleotide sequences of the invention may be used in recombinant polynucleotides. A "recombinant polynucleotide" comprises a combination of two or more chemically linked nucleic acid segments which are not found directly joined in nature. By "directly joined" is intended the two nucleic acid segments are immediately adjacent and joined to one another by a chemical linkage. In specific embodiments, the recombinant polynucleotide comprises a polynucleotide of interest or active variant or fragment thereof such that an additional chemically linked nucleic acid segment is located either 5', 3' or internal to the polynucleotide of interest. Alternatively, the chemically-linked nucleic acid segment of the recombinant polynucleotide can be formed by deletion of a sequence. The additional chemically linked nucleic acid segment or the sequence deleted to join the linked nucleic acid segments can be of any length, including for example, 1, 2, 3, 4, 5, 6, 7, 8, 9, 10, 15, 20 or greater nucleotides. Various methods for making such recombinant polynucleotides are disclosed herein, including, for example, by chemical synthesis or by the manipulation of isolated segments of polynucleotides by genetic engineering techniques. In specific embodiments, the recombinant polynucleotide can comprise a recombinant DNA sequence or a recombinant RNA sequence. A "fragment of a recombinant polynucleotide" comprises at least one of a combination of two or more chemically linked amino acid segments which are not found directly joined in nature.

By "altering" or "modulating" the expression level of a gene is intended that the expression of the gene is upregulated or downregulated. It is recognized that in some instances, plant growth and yield are increased by increasing the expression levels of one or more genes encoding PAL proteins, i.e. upregulating expression. Likewise, in some instances, plant growth and yield may be increased by decreasing the expression levels of one or more genes encoding PAL proteins, i.e. downregulating expression. Thus, the invention encompasses the upregulation or downregulation of one or more genes encoding PAL proteins. Further, the methods include the upregulation of at least one gene encoding a PAL protein and the downregulation of at least one gene encoding a second PAL protein in a plant of interest. By modulating the concentration and/or activity of at least one of the genes encoding a PAL protein in a transgenic plant is intended that the concentration and/or activity is increased or decreased by at least about 1%, about 5%, about 10%, about 20%, about 30%, about 40%, about 50%, about 60%, about 70%, about 80%, or about 90% or greater relative to a native control plant, plant part, or cell which did not have the sequence of the invention introduced.

It is recognized that the expression levels of the genes encoding PAL proteins of the present invention can be controlled by the use of one or more promoters that are functional in a plant cell. The expression level of the PAL protein-encoding gene of interest may be measured directly, for example, by assaying for the level of the photosynthetic gene transcript or of the encoded protein in the plant. Methods for such assays are well-known in the art. For example, Northern blotting or quantitative reverse transcriptase-PCR (qRT-PCR) may be used to assess transcript levels, while western blotting, ELISA assays, or enzyme assays may be used to assess protein levels. PAL activity can be measured by measuring the conversion of L-phenylalanine to trans-cinnamate or by monitoring the production of p-coumaric acid acid from L-tyrosine as described elsewhere herein.

A "subject plant or plant cell" is one in which genetic alteration, such as transformation, has been effected as to a PAL protein-encoding gene of interest, or is a plant or plant cell which is descended from a plant or cell so altered and which comprises the alteration. A "control" or "control plant" or "control plant cell" provides a reference point for measuring changes in phenotype of the subject plant or plant cell. Thus, the expression levels of a PAL protein-encoding gene of interest are higher or lower than those in the control plant depending on the methods of the invention.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e. with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

While the invention is described in terms of transformed plants, it is recognized that transformed organisms of the invention also include plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

To downregulate expression of a PAL protein-encoding gene of interest, antisense constructions, complementary to at least a portion of the messenger RNA (mRNA) for the sequences of a gene of interest, particularly a gene encoding a PAL protein of interest can be constructed. Antisense nucleotides are designed to hybridize with the corresponding mRNA. Modifications of the antisense sequences may be made as long as the sequences hybridize to and interfere with expression of the corresponding mRNA. In this manner, antisense constructions having 70%, optimally 80%, more optimally 85%, 90%, 95% or greater sequence identity to the corresponding sequences to be silenced may be used. Furthermore, portions of the antisense nucleotides may be used to disrupt the expression of the target gene.

The polynucleotides of the invention can be used to isolate corresponding sequences from other plants. In this manner, methods such as PCR, hybridization, and the like can be used to identify such sequences based on their sequence homology or identity to the sequences set forth herein. Sequences isolated based on their sequence identity to the entire sequences set forth herein or to variants and fragments thereof are encompassed by the present invention. Such sequences include sequences that are orthologs of the disclosed sequences. "Orthologs" is intended to mean genes derived from a common ancestral gene and which are found in different species as a result of speciation. Genes found in different species are considered orthologs when their nucleotide sequences and/or their encoded protein sequences share at least 75%, 80%, 85%, 90%, 91%, 92%, 93%, 94%, 95%, 96%, 97%, 98%, 99%, or greater sequence identity. Functions of orthologs are often highly conserved among species. Thus, isolated polynucleotides that have transcription activation or enhancer activities and which share at least 75% sequence identity to the sequences disclosed herein, or to variants or fragments thereof, are encompassed by the present invention.

Variant sequences can be isolated by PCR. Methods for designing PCR primers and PCR cloning are generally known in the art and are disclosed in Sambrook et al. (1989) Molecular Cloning: A Laboratory Manual (2d ed., Cold Spring Harbor Laboratory Press, Plainview, N.Y.). See also Innis et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York).

Variant sequences may also be identified by analysis of existing databases of sequenced genomes. In this manner, corresponding sequences encoding PAL proteins can be identified and used in the methods of the invention. The variant sequences will retain the biological activity of a PAL protein (i.e., PAL activity). PAL proteins catalyze the conversion of L-phenylalanine to trans-cinnamate. It is well-known that many plant PAL proteins are also capable of converting L-tyrosine to trans-p-hydroxycinnamate (Rosier et al. (1997) *Plant Physiol* 113:175-179). Assays for the detection of PAL activity are well-known in the art and may involve the spectrophotometric detection of trans-cinnamate from L-phenylalanine by monitoring light absorption at 280 nm, or by monitoring the production of p-coumaric acid acid from L-tyrosine by monitoring light absorption at 310 nm. Other suitable assays to measure PAL activity including high-performance liquid chromatography (HPLC)-based methods (Kováčik et al. (2012) *J Plant Physiol* 169:1317-1320) may also be performed.

The expression cassette will include in the 5'-3' direction of transcription, a transcriptional and translational initiation region, a polynucleotide encoding a PAL protein of the present invention, and a transcriptional and translational termination region (i.e., termination region) functional in plants.

A number of promoters may be used in the practice of the invention. The polynucleotides encoding a PAL protein of the invention may be expressed from a promoter with a constitutive expression profile. Constitutive promoters include the CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like.

Polynucleotides of the invention encoding PAL proteins of the invention may be expressed from tissue-preferred promoters. Tissue-preferred promoters include Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol. Biol.* 23(6): 1129-1138; Matsuoka et al. (1993) *Proc Natl. Acad. Sci. USA* 90(20):9586-9590; and Guevara-Garcia et al. (1993) *Plant J.* 4(3):495-505. Leaf-preferred promoters are also known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20): 9586-9590.

Developmentally-regulated promoters may be desirable for the expression of a polynucleotide encoding a PAL protein. Such promoters may show a peak in expression at a particular developmental stage. Such promoters have been described in the art, e.g., U.S. 62/029,068; Gan and Amasino (1995) *Science* 270: 1986-1988; Rinehart et al. (1996) *Plant Physiol* 112: 1331-1341; Gray-Mitsumune et al. (1999) *Plant Mol Biol* 39: 657-669; Beaudoin and Rothstein (1997) *Plant Mol Biol* 33: 835-846; Genschik et al. (1994) *Gene* 148: 195-202, and the like.

Promoters that are induced following the application of a particular biotic and/or abiotic stress may be desirable for the expression of a polynucleotide encoding a PAL protein. Such promoters have been described in the art, e.g., Yi et al. (2010) *Planta* 232: 743-754; Yamaguchi-Shinozaki and Shinozaki (1993) *Mol Gen Genet* 236: 331-340; U.S. Pat. No. 7,674,952; Rerksiri et al. (2013) *Sci World J* 2013: Article ID 397401; Khurana et al. (2013) *PLoS One* 8: e54418; Tao et al. (2015) *Plant Mol Biol Rep* 33: 200-208, and the like.

Cell-preferred promoters may be desirable for the expression of a polynucleotide encoding a PAL protein. Such promoters may preferentially drive the expression of a downstream gene in a particular cell type such as a mesophyll or a bundle sheath cell. Such cell-preferred promoters have been described in the art, e.g., Viret et al. (1994) *Proc Natl Acad USA* 91: 8577-8581; U.S. Pat. Nos. 8,455,718; 7,642,347; Sattarzadeh et al. (2010) *Plant Biotechnol J* 8: 112-125; Engelmann et al. (2008) *Plant Physiol* 146: 1773-1785; Matsuoka et al. (1994) *Plant J* 6: 311-319, and the like.

It is recognized that a specific, non-constitutive expression profile may provide an improved plant phenotype relative to constitutive expression of a gene or genes of interest. For instance, many plant genes are regulated by light conditions, the application of particular stresses, the circadian cycle, or the stage of a plant's development. These expression profiles may be important for the function of the gene or gene product in planta. One strategy that may be used to provide a desired expression profile is the use of synthetic promoters containing cis-regulatory elements that drive the desired expression levels at the desired time and place in the plant. Cis-regulatory elements that can be used to alter gene expression in planta have been described in the scientific literature (Vandepoele et al. (2009) *Plant Physiol* 150: 535-546; Rushton et al. (2002) *Plant Cell* 14: 749-762). Cis-regulatory elements may also be used to alter promoter expression profiles, as described in Venter (2007) *Trends Plant Sci* 12: 118-124.

Plant terminators are known in the art and include those available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

As indicated, the nucleotides encoding PAL proteins of the present invention can be used in expression cassettes to transform plants of interest. Transformation protocols as well as protocols for introducing polypeptides or polynucleotide sequences into plants may vary depending on the type of plant or plant cell, i.e., monocot or dicot, targeted for transformation. The term "transform" or "transformation" refers to any method used to introduce polypeptides or polynucleotides into plant cells. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. Nos. 5,563,055 and 5,981,840), direct gene transfer (Paszkowski et al. (1984) *EMBO J.* 3:2717-2722), and ballistic particle acceleration (see, for example, U.S. Pat. Nos. 4,945,050; 5,879,918; 5,886,244; and, 5,932,782; Tomes et al. (1995) in Plant Cell, Tissue, and Organ Culture: Fundamental Methods, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in The Experimental Manipulation of Ovule Tissues, ed. Chapman et al. (*Longman*, New York), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference. "Stable transformation" is intended to mean that the nucleotide construct introduced into a plant integrates into the genome of the plant and is capable of being inherited by the progeny thereof.

The cells that have been transformed may be grown into plants in accordance with conventional ways. See, for example, McCormick et al. (1986) *Plant Cell Reports* 5:81-84. In this manner, the present invention provides transformed seed (also referred to as "transgenic seed") having a polynucleotide of the invention, for example, an expression cassette of the invention, stably incorporated into their genome.

The present invention may be used for transformation of any plant species, including, but not limited to, monocots and dicots. Examples of plant species of interest include, but are not limited to, corn (*Zea mays*), Brassica sp. (e.g., *B. napus, B. rapa, B. juncea*), particularly those Brassica species useful as sources of seed oil, alfalfa (*Medicago sativa*), rice (*Oryza sativa*), rye (*Secale cereale*), sorghum (*Sorghum* bicolor, *Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (Citrus spp.), cocoa (*Theobroma cacao*), tea (*Camellia sinensis*), banana (Musa spp.), avocado (*Persea americana*), fig (*Ficus* casica), guava (*Psidium guajava*), mango (*Mangifera indica*), olive (*Olea europaea*), papaya (*Carica papaya*), cashew (*Anacardium occidentale*), macadamia (Macadamia integrifolia), almond (*Prunus amygdalus*), sugar beets (*Beta vulgaris*), sugarcane (*Saccharum* spp.), oil palm (*Elaeis guineensis*), poplar (*Populus* spp.), eucalyptus (*Eucalyptus* spp.), oats (*Avena sativa*), barley (*Hordeum vulgare*), vegetables, ornamentals, and conifers.

In one embodiment, a construct containing a promoter that is operable in a plant cell, operably linked to a coding sequence encoding a PAL protein of the present invention is used to transform a plant cell or cells. The transformed plant cell or cells are regenerated to produce transformed plants. These plants transformed with a construct comprising a functional promoter driving expression of a PAL protein-encoding polynucleotide of the invention demonstrated increased plant yield, i.e., increased above-ground biomass and increased seed yield.

Now that it has been demonstrated that upregulation of PAL increases plant yield, other methods for increasing expression of an endogenous PAL sequence in a plant of interest can be used. The expression of a PAL gene present in a plant's genome can be altered by inserting a transcriptional enhancer upstream of the PAL gene present in the plant's genome. This strategy will allow the PAL gene's expression to retain its normal developmental profile, while showing elevated transcript levels. This strategy will occur through the insertion of an enhancer element upstream of a PAL gene of interest using a meganuclease designed against the genomic sequence of interest. Alternatively, a Cas9 endonuclease coupled with a guide RNA (gRNA) designed against the genomic sequence of interest, or a cpf1 endonuclease coupled with a gRNA designed against the genomic sequence of interest, is used to effect the insertion of an enhancer element upstream of a PAL gene of interest. Alternatively, a deactivated Cas9 endonuclease fused to a transcriptional enhancer element is targeted to a genomic location near the transcription start site for a PAL gene of interest, thereby modulating the expression of said PAL gene of interest (Piatek et al. (2015) *Plant Biotechnol J* 13:578-589).

Alteration of the expression of a PAL protein-encoding gene may be achieved through the use of precise genome-editing technologies to modulate the expression of the endogenous sequence. In this manner, a nucleic acid sequence will be inserted proximal to a native plant sequence encoding the PAL through the use of methods available in the art. Such methods include, but are not limited to, meganucleases designed against the plant genomic sequence of interest (D'Halluin et al (2013) *Plant Biotechnol J* 11: 933-941); CRISPR-Cas9, CRISPR-Cpf1, TALENs, and other technologies for precise editing of genomes (Feng et al. (2013) *Cell Research* 23:1229-1232, Podevin et al. (2013) *Trends Biotechnology* 31: 375-383, Wei et al. (2013) *J Gen Genomics* 40: 281-289, Zhang et al (2013) WO 2013/026740, Zetsche et al. (2015) *Cell* 163: 759-771, U.S. Provisional Patent Application 62/295,325); N. gregoryi Argonaute-mediated DNA insertion (Gao et al. (2016) *Nat Biotechnol* doi:10.1038/nbt.3547); Cre-lox site-specific recombination (Dale et al. (1995) *Plant J* 7:649-659; Lyznik, et al. (2007) *Transgenic Plant J* 1:1-9; FLP-FRT recombination (Li et al. (2009) *Plant Physiol* 151:1087-1095); Bxbl-mediated integration (Yau et al. (2011) *Plant J* 701:147-166); zinc-finger mediated integration (Wright et al. (2005) *Plant J* 44:693-705); Cai et al. (2009) *Plant Mol Biol* 69:699-709); and homologous recombination (Lieberman-Lazarovich and Levy (2011) *Methods Mol Biol* 701: 51-65; Puchta (2002) *Plant Mol Biol* 48:173-182). The insertion of said nucleic acid sequences will be used to achieve the desired result of overexpression and/or altered expression profile of a PAL gene.

Enhancers include any molecule capable of enhancing gene expression when inserted into the genome of a plant. Thus, an enhancer can be inserted in a region of the genome upstream or downstream of a PAL sequence of interest to enhance expression. Enhancers may be cis-acting, and can be located anywhere within the genome relative to a gene for which expression will be enhanced. For example, an enhancer may be positioned within about 1 Mbp, within about 100 kbp, within about 50 kbp, about 30 kbp, about 20 kbp, about 10 kbp, about 5 kbp, about 3 kbp, or about 1 kbp of a coding sequence for which it enhances expression. An enhancer may also be located within about 1500 bp of a gene for which it enhances expression, or may be directly proximal to or located within an intron of a gene for which it enhances expression. Enhancers for use in modulating the expression of an endogenous gene encoding a PAL protein or homolog according to the present invention include classical enhancer elements such as the CaMV 35S enhancer element, cytomegalovirus (CMV) early promoter enhancer element, and the SV40 enhancer element, and also intron-mediated enhancer elements that enhance gene expression such as the maize shrunken-1 enhancer element (Clancy and Hannah (2002) *Plant Physiol.* 130(2):918-29). Further examples of enhancers which may be introduced into a plant genome to modulate expression include a PetE enhancer (Chua et al. (2003) *Plant Cell* 15:11468-1479), or a rice α-amylase enhancer (Chen et al. (2002) *J. Biol. Chem.* 277:13641-13649), or any enhancer known in the art (Chudalayandi (2011) *Methods Mol. Biol.* 701:285-300). In some embodiments, the present invention comprises a subdomain, fragment, or duplicated enhancer element (Benfrey et al. (1990) *EMBO J* 9:1677-1684).

Alteration of PAL gene expression may also be achieved through the modification of DNA in a way that does not alter the sequence of the DNA. Such changes could include modifying the chromatin content or structure of the PAL gene of interest and/or of the DNA surrounding the PAL gene. It is well known that such changes in chromatin content or structure can affect gene transcription (Hirschhorn et al. (1992) *Genes and Dev* 6:2288-2298; Narlikar et al. (2002) *Cell* 108: 475-487). Such changes could also include altering the methylation status of the PAL gene of interest and/or of the DNA surrounding the PAL gene of interest. It is well known that such changes in DNA methylation can alter transcription (Hsieh (1994) *Mol Cell Biol* 14: 5487-5494). Targeted epigenome editing has been shown to affect the transcription of a gene in a predictable manner (Hilton et al. (2015) 33: 510-517). It will be obvious to those skilled in the art that other similar alterations (collectively termed "epigenetic alterations") to the DNA that regulates transcription of the PAL gene of interest may be applied in order to achieve the desired result of an altered PAL gene expression profile.

Alteration of PAL gene expression may also be achieved through the use of transposable element technologies to alter gene expression. It is well understood that transposable elements can alter the expression of nearby DNA (McGinnis et al. (1983) *Cell* 34:75-84). Alteration of the expression of a gene encoding PAL may be achieved by inserting a transposable element upstream of the PAL gene of interest, causing the expression of said gene to be altered.

Alteration of PAL gene expression may also be achieved through expression of a transcription factor or transcription factors that regulate the expression of the PAL gene of interest. It is well understood that alteration of transcription factor expression can in turn alter the expression of the target gene(s) of said transcription factor (Hiratsu et al. (2003) *Plant J* 34:733-739). Alteration of PAL gene expression may be achieved by altering the expression of transcription factor(s) that are known to interact with the PAL gene of interest (e.g., the maize ZmMYB111 and ZmMYB148 transcription factors; Zhang et al. (2016) *Front Plant Sci* 7:148).

Alteration of PAL gene expression may also be achieved through the insertion of a promoter upstream of the open reading frame encoding a native PAL in the plant species of interest. This will occur through the insertion of a promoter of interest upstream of a PAL protein-encoding open reading frame using a meganuclease designed against the genomic sequence of interest. This strategy is well-understood and has been demonstrated previously to insert a transgene at a predefined location in the cotton genome (D'Halluin et al. (2013) *Plant Biotechnol J* 11: 933-941). It will be obvious to those skilled in the art that other technologies can be used to achieve a similar result of insertion of genetic elements at a predefined genomic locus by causing a double-strand break at said predefined genomic locus and providing an appropriate DNA template for insertion (e.g., CRISPR-Cas9, CRISPR-cpf1, TALENs, and other technologies for precise editing of genomes).

The following examples are offered by way of illustration and not by way of limitation. All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

EXPERIMENTAL

Example 1—Construction of PAL Plant Transformation Vectors

An open reading frame encoding a maize PAL protein was synthesized. This open reading frame comprised SEQ ID NO: 1, encoding the protein sequence of SEQ ID NO: 2. Appropriate restriction sites were included at the 5' and 3' ends of the coding sequence to allow this DNA to be cloned into plant transformation vectors that contained genetic elements suitable for controlling gene expression. In each plant transformation construct, the PAL open reading frame was located downstream of a plant promoter and 5' untranslated region (5'UTR) and upstream of a 3'UTR. Table 2 summarizes the plant transformation constructs that were built containing a PAL open reading frame.

TABLE 2

PAL plant transformation constructs

| Construct ID | Promoter + 5' UTR | ORF | 3' UTR |
|---|---|---|---|
| 130609 | ZmUbi (SEQ ID NO: 3) | PAL (SEQ ID NO: 1) | ZmUbi (SEQ ID NO: 4) |
| 130925 | 2x35S (SEQ ID NO: 5) | PAL (SEQ ID NO: 1) | 35S poly A (SEQ ID NO: 6) |
| 130996 | ZmRbcS (SEQ ID NO: 7) | PAL (SEQ ID NO: 1) | ZmRbcS (SEQ ID NO: 8) |
| 131094 | 4xRGCGR (SEQ. ID NO: 9) | PAL (SEQ ID NO: 1) | ZmCA (SEQID NO: 10) |
| 131143 | NHD (SEQ. ID NO: 11) | PAL (SEQ ID NO: 1) | NHD (SEQ ID NO: 12) |
| 131174 | GLDC (SEQ ID NO: 13) | PAL (SEQ ID NO: 1) | ZmRbcS (SEQ ID NO: 8) |
| 131556 | ZmUbi (SEQ ID NO: 3) | PAL (SEQ ID NO: 1) | ZmUbi (SEQ ID NO: 4) |

In addition to the single-genic PAL plant transformation constructs listed in Table 2, multigenic plant transformation constructs containing a PAL gene cassette and a second linked cassette were also built. Table 3 summarizes the multigenic PAL plant transformation constructs.

TABLE 3

PAL multigenic plant transformation constructs

| Construct ID | Promoter + 5'UTR #1 | ORF #1 | 3'UTR #1 | Promoter + 5'UTR #2 | ORF #2 | 3'UTR #2 | Promoter + 5'UTR #3 | ORF #3 | 3'UTR #3 |
|---|---|---|---|---|---|---|---|---|---|
| 131549 | ZmUbi (SEQ ID NO: 3) | PAL (SEQ ID NO: 1) | ZmUbi (SEQ ID NO: 4) | ZmRbcS (SEQ ID NO: 7) | RbcS-ictB (SEQ ID NO: 116) | ZmRbcS (SEQ ID NO: 8) | n/a | n/a | n/a |
| 131550 | ZmUbi (SEQ ID NO: 3) | PAL (SEQ ID NO: 1) | ZmUbi (SEQ ID NO: 4) | LOC_Os01g45274 (SEQ ID NO: 118) | SBPase (SEQ ID NO: 120) | LOC_Os01g45274 (SEQ ID NO: 119) | n/a | n/a | n/a |
| 131801 | ZmUbi (SEQ ID NO: 3) | PAL (SEQ ID NO: 1) | ZmUbi (SEQ ID NO: 4) | ZmRbcS (SEQ ID NO: 7) | RbcS-ictB (SEQ ID NO: 116) | ZmRbcS (SEQ ID NO: 8) | LOC_Os01g45274 (SEQ ID NO: 118) | SBPase (SEQ ID NO: 120) | LOC_Os01g45274 (SEQ ID NO: 119) |
| 131829 | ZmUbi (SEQ ID NO: 3) | PAL (SEQ ID NO: 1) | ZmUbi (SEQ ID NO: 4) | ZmCA (SEQ ID NO: 122) | bZIP transcription factor (SEQ ID NO: 123) | ZmCA (SEQ ID NO: 10) | n/a | n/a | n/a |
| 132187 | ZmUbi (SEQ ID NO: 3) | PAL (SEQ ID NO: 1) | ZmUbi (SEQ ID NO: 4) | ZmRbcS (SEQ ID NO: 125) | ictB (SEQ ID NO: 126) | ZmRbcS (SEQ ID NO: 8) | n/a | n/a | n/a |

In addition to the gene cassettes described in Tables 2 and 3, each plant transformation construct listed in Tables 2 and 3 also contained a selectable marker cassette suitable for the selection of transformed plant cells and regeneration of plants following the introduction of the plant transformation vector, as described below. Each transformation vector was built in a plasmid that contained sequences suitable for plasmid maintenance in E. coli and in Agrobacterium tumefaciens. Following verification that the plant transformation constructs listed in Tables 2 and 3 contained the desired sequences, they were transformed into A. tumefaciens cells for plant transformation.

Example 2—Transformation of Setaria viridis

A. tumefaciens cells harboring PAL plant transformation vectors were used to transform S. viridis cells according to a previously described method (PCT/US2015/43989, herein incorporated by reference). Following transformation of the S. viridis cells with the relevant plant transformation vectors and regeneration of S. viridis plants, PCR analyses were performed to confirm the presence of the gene(s) of interest in the S. viridis genome. Table 4 summarizes the transformation constructs used to transform S. viridis, along with the number of PCR-verified transgenic plants that resulted from transformation with each construct.

TABLE 4

Summary of S. viridis transformation with PAL plant transformation vectors

| Construct | # Events |
|---|---|
| 130609 | 9 |
| 130925 | 45 |
| 130996 | 16 |
| 131094 | 30 |
| 131143 | 0 |
| 131174 | 31 |

Example 3—Transformation of Maize (Zea mays)

A. tumefaciens cells harboring PAL plant transformation vectors were used to transform maize (Zea mays cv. B104) cells suitable for regeneration on tissue culture medium. Following transformation of the maize cells with the relevant plant transformation vectors and regeneration of maize plants, PCR analyses are performed to confirm the presence of the gene(s) of interest in the maize genome. Transformation vector number 131556 was used for maize transformation.

Example 4—Transformation of Rice (*Oryza sativa*)

*A. tumefaciens* cells harboring PAL plant transformation vectors were used to transform rice (*Oryza sativa* cv. Kitaake) cells suitable for regeneration on tissue culture medium. Following transformation of the rice cells with the relevant plant transformation vectors and regeneration of rice plants, PCR analyses were performed to confirm the presence of the gene(s) of interest in the rice genome. Transformation vector number 130925 was used for rice transformation, resulting in the production of fifteen PCR-verified transgenic plants containing the PAL gene cassette.

Example 5—Characterization of Transgenic *S. viridis*

Following the transformation and regeneration of *S. viridis* plants transformed with a PAL plant transformation vector, the T0-generation plants were cultivated to maturity to produce T1-generation seeds. T1-generation *S. viridis* plants harboring the PAL gene cassette of interest were grown in a greenhouse setting to assess the effects of PAL gene expression on plant growth and terminal above-ground biomass and seed yield. A randomized block design was used with a wild-type *S. viridis* border row to eliminate edge effects from the analysis. Null segregant plants, i.e., plants grown from seed that was harvested from the same T0-generation plants used to produce the transgenic T1 seed harboring the PAL gene cassettes, but lacking the PAL gene cassette, were grown alongside the transgenic *S. viridis* plants in identical environmental conditions. Table 5 summarizes the results of the biomass and seed yield determinations made from experiments with T1-generation *S. viridis* plants harboring a PAL gene cassette as a result of transformation. It should be noted that growth conditions (e.g., temperature and light conditions) likely changed between the experiment used to test the 130925 events and the experiment used to test the 130609 events, and thus there were differences in growth between these two experiments; comparisons were made between transgenic and null segregants grown under identical environmental conditions. This table indicates the construct used for transformation, as described in Tables 2 and 3, followed by the T0 event number from which the T1 seed was harvested.

TABLE 5

Summary of *S. viridis* greenhouse observations with T1-generation plants

| | DW (g) | Seed Yield (g) | HI (%) | DW Change (%) | Seed Change (%) | HI Change (%) |
|---|---|---|---|---|---|---|
| 130925-17A | 3.83 ± 0.20 | 0.52 ± 0.04 | 13.5% | −0.3% | 6.9% | 6.0% |
| 130925-26 | 3.80 ± 0.27 | 0.52 ± 0.04 | 13.8% | −1.0% | 8.4% | 9.0% |
| 130925-4A | 3.43 ± 0.27 | 0.46 ± 0.04 | 13.3% | −10.6% | −5.4% | 6.7% |
| 130925-9A | 4.00 ± 0.22 | 0.50 ± 0.02 | 12.6% | 4.3% | −1.2% | −6.0% |
| 130925-null | 3.90 ± 0.22 | 0.48 ± 0.02 | 12.4% | n/a | n/a | n/a |
| 130609-01 | 2.55 ± 0.14 | 0.55 ± 0.05 | 21.6% | −11.0% | −24.6% | −15.3% |
| 130609-02 | 2.99 ± 0.18 | 0.73 ± 0.09 | 24.4% | 4.3% | −0.5% | −4.6% |
| 130609-03a | 3.23 ± 0.14 | 0.78 ± 0.06 | 24.1% | 12.9% | 6.6% | −5.5% |
| 130609-04a | 3.19 ± 0.12 | 0.80 ± 0.07 | 25.2% | 11.4% | 9.8% | −1.4% |
| 130609-07 | 3.41 ± 0.15 | 0.84 ± 0.09 | 24.5% | 18.9% | 14.2% | −4.0% |
| 130609-null | 2.72 ± 0.23 | 0.73 ± 0.10 | 26.9% | n/a | n/a | n/a |
| 131174-17 | 2.64 ± 0.43 | 0.64 ± 0.10 | 24.9% | −24.9% | −3.5% | 61.5% |
| 131174-2A | 2.33 ± 0.67 | 0.60 ± 0.18 | 22.3% | −39.9% | −12.3% | 17.4% |
| 131174-3 | 3.96 ± 0.20 | 0.73 ± 0.06 | 18.7% | 39.3% | 14.7% | −41.9% |
| 131174-5 | 1.56 ± 0.61 | 0.19 ± 0.10 | 10.0% | −77.3% | −98.4% | −187.7% |
| 131174-Null | 3.15 ± 0.68 | 0.66 ± 0.15 | 21.2% | n/a | n/a | n/a |
| 131094-1 | 3.28 ± 0.49 | 0.75 ± 0.12 | 22.9% | 27.7% | 20.3% | 3.2% |
| 131094-12 | 2.49 ± 0.45 | 0.53 ± 0.11 | 21.7% | −3.1% | −14.6% | −2.2% |
| 131094-17A | 2.91 ± 0.20 | 0.72 ± 0.06 | 24.9% | 13.3% | 15.7% | 12.2% |
| 131094-18B | 3.31 ± 0.43 | 0.89 ± 0.14 | 25.8% | 28.9% | 41.4% | 16.3% |
| 131094-2 | 2.45 ± 0.32 | 0.55 ± 0.11 | 20.4% | −4.5% | −11.6% | −8.0% |
| 131094-3 | 2.31 ± 0.37 | 0.55 ± 0.12 | 21.9% | −10.0% | −11.7% | −1.5% |
| 131094-6 | 2.92 ± 0.49 | 0.69 ± 0.13 | 24.5% | 13.6% | 9.5% | 10.6% |
| 131094-Null | 2.57 ± 0.34 | 0.63 ± 0.10 | 22.2% | n/a | n/a | n/a |

In Table 5, the dry weight of the above-ground biomass is indicated in the DW column in grams. Similarly, the dry weight of the harvested seeds is indicated in grams in the Seed Yield column. The HI column indicates harvest index (seed yield divided by dry weight, expressed as a percent).

The DW Change, Seed Change, and HI Change columns indicate the percent change in above-ground biomass, seed yield, and harvest index, respectively, relative to the null segregants from the appropriate construct. As this table shows, one out of four events from the 130925 construct produced increased above-ground biomass relative to null segregant controls, while two out of four events produced increased seed relative to null segregant controls and three out of four events showed an increased harvest index relative to null segregant controls. Four out of five events from the 130609 construct produced increased above-ground biomass relative to null segregant controls, and three out of five events produced increased seed relative to null segregant controls, though the 130609 events all showed a slight decrease in harvest index relative to null segregant controls. One out of four 131174 events tested showed an increase in dry weight and seed yield relative to null segregant controls, while two out of four events tested showed increased harvest index relative to null segregant controls. Four out of seven 131094 events tested showed increased biomass, seed yield, and harvest index relative to null segregant controls.

Example 6—Characterization of Transgenic Maize

T0-generation maize plants transformed with the PAL plant transformation vector of interest and confirmed to contain the gene(s) of interest are grown to maturity in a greenhouse. When the T0 plants reach reproductive stages, they are pollinated by an appropriate inbred maize line to produce hybrid maize seeds. Alternatively, or in addition to pollination of the T0 transgenic maize plant, the pollen from the T0 is used to pollinate one or more inbred maize lines to produce hybrid maize seeds. The F1-generation hybrid seed resulting from these pollinations are planted in a field setting in two- or four-row plots and cultivated using standard agronomic practices. Plants are genotyped to determine which plants do and which do not contain the PAL gene cassette and any other relevant gene cassettes (e.g., a selectable marker gene cassette) that were included in the PAL plant transformation vector. Following the maturation of the maize plants, the seed is harvested. Seeds from the plants containing the PAL gene cassette are pooled, as are seeds from the null segregant plants lacking the PAL gene cassette. The seeds are weighed, and seed yields are calculated for the plants containing the PAL gene cassette as well as for the null segregant plants lacking the PAL gene cassette. Appropriate statistical analyses are performed to determine whether plants containing a PAL gene cassette produced higher yields than those plants that lacked a PAL gene cassette.

Alternatively, T0-generation maize plants transformed with the PAL plant transformation vector of interest and confirmed to contain the gene(s) of interest are grown to maturity in a greenhouse, then self-pollinated. The resulting T1 seeds are planted in a greenhouse and the T1 plants are cultivated. T1 plants are genotyped to identify homozygous, heterozygous, and null segregant plants. Pollen from homozygous T1 plants is used to pollinate one or more inbred maize lines to produce hybrid maize seeds. Pollen from null segregant plants is also used to pollinate one or more inbred maize lines to produce hybrid maize seeds. The resulting hybrid seeds are planted in a field setting in two- or four-row plots and cultivated using standard agronomic practices. Following the maturation of the maize plants, the seed is harvested. Seeds from the plants containing the PAL gene cassette are pooled, as are seeds from the null segregant plants lacking the PAL gene cassette. The seeds are weighed, and seed yields are calculated for the plants containing the PAL gene cassette as well as for the null segregant plants lacking the PAL gene cassette. Appropriate statistical analyses are performed to determine whether plants containing a PAL gene cassette produced higher yields than those plants that lacked a PAL gene cassette.

Example 7—Characterization of Transgenic Rice

T0-generation rice plants transformed with the PAL plant transformation vector of interest and confirmed to contain the gene(s) of interest are grown to maturity in a greenhouse, then self-pollinated. The resulting T1 seeds are planted in a greenhouse and the T1 plants are cultivated. T1 plants are genotyped to identify homozygous, heterozygous, and null segregant plants. The plants from each group are grown to maturity and allowed to self-pollinate to produce T2 seed. The T2 seed resulting from this self-pollination is harvested and weighed, and seed yields from homozygous, heterozygous, and null segregant plants are calculated. Appropriate statistical analyses are performed to determine whether plants containing a PAL gene cassette produced higher yields than those plants that lacked a PAL gene cassette.

T1-generation plants grown from seed that resulted from self-pollination of T0-generation plants, or T2-generation plants grown from seed that resulted from self-pollination of homozygous T1-generation plants, are grown in a field setting. In the case of T2-generation plants, null-segregant T1-generation plants are also self-pollinated to produce T2-generation null plants as negative controls. The plants are cultivated using standard agronomic practices and allowed to reach maturity. Upon reaching maturity, the plants are allowed to self-pollinate. The seed resulting from these self-pollinations is harvested and weighed, and seed yields from homozygous, heterozygous, and null segregant plants are calculated. Appropriate statistical analyses are performed to determine whether plants containing a PAL gene cassette produced higher yields than those plants that lacked a PAL gene cassette.

SEQUENCE LISTING (127 sequences)

SEQ ID NO: 1 - DNA, 2148 bp, Zea mays
  misc_feature (1)..(2148): Phenylalanine ammonia lyase
atggaatgcgaaaacgggcacctcgcggccagcggcaatgggggggtgtgtctggccaccccggcgccgcgcgcggatccactgaattgggcgaaagccgcggaagatctcgcggggagccatctcgacgcggtcaaacgcatggtggaggagtataggcgcccgctggtcaagattgaaggcgcgtccctgaccgtggcgcaggtcgcggccgtggcggcggccggggaagcgagggtcgagctcgacgagagcgcccgcgggagggtcaaagccagctccgactgggtcatggattccatgatgaatggcaccgatagctatggcgtcacaaccggctttggggcgacctcccacaggaggacaaaggagggcggggccctccaacgcgagctgattaggtttctcaatgccggcgcgttcggcacaggggatgacggccatgtcctgccagcggccgcgacccgcgcggccatgctcgtgaggattaacacactgctccaaggctatagcgggatccgctttgagattctggaggccatcgccgcgctgctgaacacaaacgtcacaccgtgtctcccgctgaggggcaccattacagcgtccggggatctggtgccgctgagctacatcgccgggctcgtcaccggcaggccaaacagcacagccgtcgccccggatgggaggaaggtcggggcggccgaagcgttcgaaattgcggggattcagcacgggttcttcgaactgcagccgaaagaggggctcgccatggtgaacggcaccgcggtcggcagcgggctggccagcatggtcctctttgaagcgaacgtgctcgccgtcctcgccgaagtgatgtccgcggtcttctgcgaagtgatgaacggcaaaccagaatacacagatcacctcacacataagctgaagcatcacccagggcaaattgagtccgccgccattatggagcatatcctcgaaggctccagctacatggcgctggccaagaagctgggggagctcgatccactcatgaagccaaaacaagacaggtatgcgctgaggacatccccacagtggctggggccacaaattgaagtgatcaggtccgccacaaagtccatcgagagggagattaatagcgtgaatgacaatccactgattgacgtgagcagggggaaagcgctccacggcgggaatttccaggggaccccaatcggcgtgagcatggacaatacacgcctggccgtggcggccatcggcaagctgatgtttgcccagttcagcgaactggtcaatgacttctataacaatgggctgccgagcaacctgtccggggggcgcaatccgagcctcgattacggcttcaaaggcgccgagatcgccatggcgagctactgcagcgagctgcaattcctcgccaatccggtgacaaaccacgtccagagcgcggagcagcacaatcaggacgtgaattccctggggctcatcagcagcaggaagacagcggaagcggtggatgtgctcaagctcatgagctccacctttctcgtggcgctctgccaagccatcgacctccgccacctggaggagaacctgaggagcgcggtgaagcgctgcgtgacagtcgtcgcgcgcaaaacactctccacaggcgcgacaggcgccctgcacgacgcgcgcttctgcgagaaggacctgctgaccgcgatcgaacgcgaggcggtgttcgcctacgcggacgatccatgttccgccacctatccactgatgcagaagatgcgcagcgtcctggtggaacatgcgctggcgaacggcgaagcggagcgcgacccggatacctccgtgttcgcgaaagtggccacatttgaagaggaactcagggccgccctgccaagggaggtggacgcggcgcgcgccgccgtcgagagcggcacagcggcgattcgcaacaggattgccgaatgtaggagctatccactctaccgctttgtccgcgaagaactggggaccgaatacctcaccggggagaaggcccgctccccgggggaagaagtcgacaaagtgttcgtcgcgatgaacctcgggaaacacattgacgcggtgctcgagtgtctcaaggaatggaacggcgaaccgctcccaatttgttga

SEQ ID NO: 2 - protein, 715 aa, Zea mays
  MISC_FEATURE (1)..(715): Phenylalanine ammonia lyase
MECENGHLAASGNGGVCLATPAPRADPLNWAKAAEDLAGSHLDAVKRMVEEYRRPLVKIEGASLTVAQVAAVAAAGEARVELDESARGRVKASSDWVMDSMMNGTDSYGVTTGFGATSHRRTKEGGALQRELIRFLNAGAFGTGDDGHVLPAAATRAAMLVRINTLLQGYSGIRFEILEAIAALLNTNVTPCLPLRGTITASGDLVPLSYIAGLVTGRPNSTAVAPDGRKVGAAEAFEIAGIQHGFFELQPKEGLAMVNGTAVGSGLASMVLFEANVLAVLAEVMSAVFCEVMNGKPEYTDHLTHKLKHHPGQIESAAIMEHILEGSSYMALAKKLGELDPLMKPKQDRYALRTSPQWLGPQIEVIRSATKSIEREINSVNDNPLIDVSRGKALHGGNFQGTPIGVSMDNTRLAVAAIGKLMFAQFSELVNDFYNNGLPSNLSGGRNPSLDYGFKGAEIAMASYCSELQFLANPVTNHVQSAEQHNQDVNSLGLISSRKTAEAVDVLKLMSSTFLVALCQAIDLRHLEENLRSAVKRCVTVVARKTLSTGATGALHDARFCEKDLLTAIEREAVFAYADDPCSATYPLMQKMRSVLVEHALANGEAERDPDTSVFAKVATFEEELRAALPREVDAARAAVESGTAAIRNRIAECRSYPLYRFVREELGTEYLTGEKARSPGEEVDKVFVAMNLGKHIDAVLECLKEWNGEPLPIC

SEQ ID NO: 3 - DNA, 1992 bp, Zea mays
  misc_feature (1)..(1992): ZmUbi promoter and 5'UTR
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatactactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 4 - DNA, 623 bp, Zea mays
  misc_feature (1)..(623): ZmUbi 3'UTR
gtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgat

SEQ ID NO: 5 - DNA, 780 bp, Cauliflower Mosaic Virus
  promoter (1)..(780): 2X35S promoter and 5'UTR
atggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctct

SEQ ID NO: 6 - DNA, 209 bp, Cauliflower Mosaic Virus
  terminator (1)..(209): 35S polyA terminator
gatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 7 - DNA, 974 bp, Zea mays
  promoter (1)..(974): ZmRbcS promoter and 5'UTR
gagctccctttaatctggcgctagatctgcatccgcggcttgcaaagataaatggcacatttagtgtgttattttgcaatacctttcatagtagatatccttaaatgcagttttaggcatgtttgggtaattaaataacatttttaggaggagttttagatttacctttctttcgtgatgactgatgacagacgtggggaattcaaatgcaactctagcgaaagttcatatatttttcataaatagctgaggctggggtaattattttttttgtagaaaaatagaataggtggaatggttggggaaggcgtaggcgctcgtggacgacgcccgataaaagacaagaggcggaattgccatgaattcgaggtagctaagtaaggcgcatatatatgccaaaaaattctactgtcactttccaatttcaatgcgctgccaaacaagccatcctggaaactgacttgaattcagcccaattctgtagatccaaacagggccggcgtcagtgcctcaggtgagagagcagcagacgatgcaaagagccaaaactgcaagcagacgcagccgaagccgaagccgaagcccaagcccaaaactgttttgtctttgcccagaaccgcgacgagcctaaactgcgcttcctcctatctacaagtccctggcacatcacgcatagtccaaccatggcgcgcaggcgataaggcgcgccacggggacgcgacatgtggtggcggacgcgatcaggatagggccaggctggccgggcgcggccacgggagaacggtggccactcgtcccacatccgcttcgtcctgtcctgtactgcgtcctgcccccaacgagagccggagccggccatcccgtcgcacactctccccctctatatatgccgtcggtgtgggggagcctactacaggacgacccaagcaagcaagcaagcagcgagtacatacatactaggcagccaggcagcc

SEQ ID NO: 8 - DNA, 439 bp, Zea mays
  misc_feature (1)..(439): ZmRbcS 3'UTR
accgcgcccgccggccgccccccgccggctagctagctagctagctcctgcgtgagctagtagctagtgccatgcgtcgtctctgtcgttcggttttgcttcgggtcaccgtgtaccctttgcttgcttggtttcttctttccttttttcctttttttttcttcttttccccggccatggttcctttgctttccagcagttctctgctggatgtgatgtatccattgttgcaatcatggccttgcattggctacctctatacctgctacaaaactactgcaacgcctatatatacttggggtgaggaacatgtgaatgcaagctccggctatcatatacatgtaatatggatacaaactatatatataaatccgccgaggcgccgacaatactatacgacaccgtgttaagttaatatataactggtgctttttattta

SEQ ID NO: 9 - DNA, 741 bp, Sorghum bicolor
  promoter (1)..(741): 4xRGCGR Promoter and SbCA 5'UTR
gaagcgagtggcgcgctggcggatgaggcggcgagtggcccggatgcaccggcgcaggcgagcgaagcgagtggcgcgctggcggatgaggcggcgagtggcccggatgcaccggcgcaggcgagcgaagcgagtggcgcgctggcggatgaggcggcgagtggcccggatgcaccggcgcaggcgagcgaagcgagtggcgcgctggcggatgaggcggcgagtggcccggatgcaccggcgcaggcgagccgcacgccgccgcccgccgcggcgctcgcgcgcgcaccgctgccgcctgccgccacacaatgcgagcgcgcgcgcacacacacacacaccacccgggcgggggggctgtagtagtaacggccttgtcttgtcggcacgcgcgcgtccgtgtgtataaggaggcaggcccgcgacaacgataagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaatcga

SEQ ID NO: 10 - DNA, 287 bp, Zea mays
  misc_feature (1)..(287): ZmCA 3'UTR
gttcaaaactagggctacggcaattctaccggcccgccgactcctgcatcatcataaatatatatactatactatactactacgtacctaccgatatgcacccgagcaatgtgaatgcgtcgagtactatatatctgttttctgcatctacatatatataccggatcaatcgcccaatgtgaatgtaataagcaatatcattttctaccacttttcattcctaacgctgagctttttatgtactatatcttatatgatgaataataatatgaccgccttgtgatcta

SEQ ID NO: 11 - DNA, 2000 bp, Setaria italica
  promoter (1)..(2000): NHD Promoter and 5'UTR
gtggtggccgttcactggtggaaaagtgagcattagtcccggttggagagacgcataggtctcgaaaattcaaccaggactaatcttttgagactaaaggcccccatctttagtcccgggtatttcacccaggactaaagaccttctttagtcccggaccaaccgggactaaaaaggttaaaaaaataaaaaaatggaccacccccacctacggcagctcgcccgtgccagccgcctgcccgccccagctcgcctgctcgcaccggccgccgagagctgcgccagctcgcccgcccgcgtcggccgctcgctcgtgtcggccaaccgcctacccacgctggcgctcgcccgcccgccccagcttgcccgcccacatcggccgccgggagccgcgctagctcacccgcccgaggccggcccgcaccgctcgtggcccccgtcactccgcttggaagaaagggagtggaggaggagagaagataaggaagaagagaaagagtgctgcctgcgcaagataagggaaaaatggagaggaggagagaagataaggtggagagaaagggggactgcgtgaaaagattagtcccgattggtaaagggaagcctttagtcccggttggtgttttcaaccgggactaaaaggcctaccagattttctcatcccactaccctttagtcctagttgatattaccaaccgagactaaagctcccgtcatcggtggctatcggtggtggccgtttgatccgggactaaaggccctttagttccgggtccagaaacgatcgggactaaaaatgctggatggaaggtctcttctctactagtggcctgacccgtcccaggtccaaaaagcgtcgagacatgttacgctggatggagctttagtcccgatcaaaaagcatcgagacatattacgctggatggaaggtctattgtctaccggtgtttcccaacccaactcaactcagctgttcattgttttgacagtaggggtgttgcacaaagctacttggttttgctagttttctgaaagctaattgatcactacagtctctcgttcgtgcattaacgttctcattgtttctttctcatttcgctcatgtatgcgcgaagcagatcctttgtttgaggattcttgttgataaattgggctgcttcgttgtgtggtgtggtgtgtgtgtggtgtgtgtggtgtgtgtgtttgtttgtttttttgtgtgttgatagctttgttccatggatcggagtgccaagttggcgaaactaggctaggccagtgaagttcgattcagagattgaaaacgtagtccgatgctaggctagtaacgttctgaactcttttctttctttcccttgaccttacaaattggctcagccgttttattttcattttcttttccttgcctttttaaattagcttagccgtttttcatttctttcttctttcacactttgcttttcttattttagaaagccccgcaaatattttcaaagcaagaatccaatgttctagcacagctttgacattcacaacaatccaacaaattctcgtttggctggagaaatggaatgtgttccatgtttcgtcaccccatctctcatatgcataaacgtaaggatttggaatcatcgtataaaagttcacgggatgggatcaactcaagataccgagatctctctccttaaatcatacaattcttattttcagaacttggttggttagcttccaatttttgtctagccaaaatcaaagtatgtcaaaattaagataagaaatttagatgttcacttgatttaaactaaaatacgacgaccaatacttttttcacaaccaaatgtccccaacgtgctcacagctccgcctttcaaaggttatcattatcattgtttctttctaggtttattcaaaaaaggtttcttttctaggaaagagattgctgccacaagttattgtaaaggcctccagtaacggaatgccctggaccgctacacgctact

SEQ ID NO: 12 - DNA, 400 bp, Setaria italica
  misc_feature (1)..(400): NHD 3'UTR
atggacgtttgctctgcatctttgcgaagctcgggaatcaacacgcatagcaatcaacaaacgttagatatcgtcatctttctcacacatggagtagaaatacttaaaagtaacctcatacgcatgaatgttttatgtttgtaatatatttcatactaaataagaattctaaagagacatattctatccaaaatcattcatcaaacatgcaattgaccaagaactggcaggtcaggcgctctctaaccacaacgctccctgcagcgttacactatcaatatatttctatgcttccaacacgtccttatacacaatgttcttagttctcttaccaggaggatcggcatcaatgttaggtttggccaaaacccacgtagtatttcgtgcaacacctctagac

SEQ ID NO: 13 - DNA, 1571 bp, Flaveria bidentis
  promoter (1)..(1571): GLDC Promoter and 5'UTR
aagctttactcctctcaactttcaaatcataacataaaagttcgtaggtttgtgttcttcccaaaaaaaaagtgattttttttcatcggttaattcatgattaacatttcgacattcattccactatttcacatcatgttttgatgggagattgaaatagcgataaggcgaatgtgaaagtgtgaaacaggatgagccacaccatcaccacatcacaatttacccaaataatatcccaaagattcatacgcattttgatccactgaaaccccatccaattctatccaatgcccaccacatgttcgacgatttgcctcagtgaatcaagaccaacacatgccactgctttctgctttttagtccctgataacaaacgattggctttcattgctcactgtagaaagtggagacacccaacaactatcatctccacgtggttccgtgccgcctttttgcctttcatactgctggtgcgtcatttgtcgtcatcaaagcactcacccactatcattgatctcgaaatcttgaatctttaggtttttatgctttgatacttgaactctacacacagtctcgtatctgactttttgttatctgtgttttgctttactaaagatctcacctttaatcaagttttgaacttttgatggatttgtcatgataatgaagaacacatagttattattgattatattttgacgaatcttttttcatgatcgttaaacataatttgagttctttttaccttgtctttctttgaggtttaactgtacatgaagactgtattttgagtttattgcataaatggtctatatagtttgggttaaaacaactggttttaatatcaagtttgatactagacaaaccaactttttgattaacttttaaaaaaattaataagtctatttggaaaaaaattgaaaatttgattttaaagggttaaaagttctttttgaaaagttaataagagtaacttttgaaatgtaacttttaaaaaaatactgttgataaaaaaagaaatcctaatcatgggcttagtattgtaagtagcttggatattgaagctaatttttcactttatatttatagaaaagttaatggaagtaagaggtttggatactttttttcttaatttagacgaatgttacacatgaaaaataagcgttgttttgtaagatttttttaattcgcaagcactaaactcctaatcaacttttggggttaaggagtaggcagtaaaccaaaagcgtttttgcacgatacgatgttcaaacatttgatctataacgataagtccaagtgcgttacaaaatgaaactttggtatccaatatgaaactgggtgtgtagttcagtaccaaaagcataactttcagcctccttagtgacttatgactaggcaagagaacatgtgagcccaatgtactaactttttaccccttttattaccaccaccccagccccccaccatgaaccgatcagaaaaagaagcaagaaaaacagagcattcttgctccttcttcttcatcaattcaataacattcttcataccattagaccccatcttacact

SEQ ID NO: 14 - protein, 715 aa, Setaria italica
  MISC_FEATURE (1)..(715): Phenylalanine ammonia lyase
MECENGHVVAANGNGVCLPVPPRADPLNWGKAAEDLSGSHLEAVKRMVEEYRRPLVRIEGSSLTVAQVAAVANGAGEARVELDESARGRVKASSDWVMNSMMNGTDSYGVTTGFGATSHRRTKEGGALQRELIRFLNAGAFGTGDDGHVLPASATRAAMLVRINTLLQGYSGIRFEILETIASLLNANVTPCLPLRGTITASGDLVPLSYIAGLVTGRPNSVAVTADGKKVGAAEAFKAAGIQHGFFELQPKEGLAMVNGTAVGSGLASMVLFEANVLAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAVDILKLMSSTFLIALCQAIDLRHLEENLKGAVKSCVMTVAKKTLSTGATGALHNARFCEKDLLTAIDREAVFAYADDSCSANYPLMQKMRSVLVEHALANGEAERDPETSVFAKVATFEEEIRAALPREVEAARAAVENGTAAIPNRIAECRSYPLYRFVREELGTQYLTGEKTRSPGEEVDKVFVAMNLGKHIDAVLECLKEWNGEPLSIC

SEQ ID NO: 15 - protein, 850 aa, Setaria italica
  MISC_FEATURE (1)..(850): Phenylalanine ammonia lyase
MKCPQNGKDARPDVTGTQDGDNDDSREPKQACPVRPPPACSTPAPLPAPTPVVSSPRAARTHQSHKPHLSMAPPGGCRKAATAQLYVAEEPEPPPPLVLASSSPLHVSSIHPGRPSQLPSFQTQSRAHKPLRRFEMECENGHVVAANGNGVCLPVPPRADPLNWGKAAEDLSGSHLEAVKRMVEEYRRPLVRIEGSSLTVAQVAAVANGAGEARVELDESARGRVKASSDWVMNSMMNGTDSYGVTTGFGATSHRRTKEGGALQRELIRFLNAGAFGTGDDGHVLPASATRAAMLVRINTLLQGYSGIRFEILETIASLLNANVTPCLPLRGTITASGDLVPLSYIAGLVTGRPNSVAVTADGKKVGAAEAFKAAGIQHGFFELQPKEGLAMVNGTAVGSGLASMVLFEANVLAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAVDILKLMSSTFLIALCQAIDLRHLEENLKGAVKSCVMTVAKKTLSTGATGALHNARFCEKDLLTAIDREAVFAYADDSCSANYPLMQKMRSVLVEHALANGEAERDPETSVFAKVATFEEEIRAALPREVEAARAAVENGTAAIPNRIAECRSYPLYRFVREELGTQYLTGEKTRSPGEEVDKVFVAMNLGKHIDAVLECLKEWNGEPLSIC

SEQ ID NO: 16 - protein, 764 aa, Sorghum bicolor
  MISC_FEATURE (1)..(764): Phenylalanine ammonia lyase
MPPPAPFPSKKSLRLRLLWYSSSSSPLHVSSSRRPPQLPPSLLQTQSKLDMECENGHAAGASGNGVCLATPRAADPLNWGKAAEDLTGSHLEAVKRMVEEYRRPLVKIEGASLTVAQVAAVAAAGEARVELDESARGRVKASSDWVMNSMMNGTDSYGVTTGFGATSHRRTKEGGALQRELIRFLNAGAFGTGDDGHVLPAAATRAAMLVRINTLLQGYSGIRFEILETIAALLNANVTPCLPLRGTITASGDLVPLSYIAGLVTGRPNSTAVAPDGRKVGAAEAFKIAGIQHGFFELQPKEGLAMVNGTAVGSGLASMVLFEANVLAVLAEVMSAVFCEVMNGKPEYTDHLTHKLKHHPGQIESAAIMEHILDGSSYMMLAKKMGELDPLMKPKQDRYALRTSPQWLGPQIEVIRAATKSIEREINSVNDNPLIDVSRGKALHGGNFQGTPIGVSMDNTRLAVAAIGKLMFAQFSELVNDFYNNGLPSNLSGGRNPSLDYGFKGAEIAMASYCSELQFLANPVTNHVQSAEQHNQDVNSLGLISSRKTAEAVDVLKLMSSTFLIALCQAVDLRHLEENLKSAVKSCVTTVAKKTLSTSATGGLHNARFCEKDLLTAIDREAVFAYADDPCSANYPLMQKMRSVLVEHALANGEAERDPETSVFAKVATFEEELRAALPREVDAARAAVENGTAAVPNRIAECRSYPLYRFVREELGTEYLTGEKTRSPGEEVNKVFVAMNLGKHIDAVLECLKEWNGEPLPIC

SEQ ID NO: 17 - protein, 714 aa, Oryza sativa
  MISC_FEATURE (1)..(714): Phenylalanine ammonia lyase
MECENGHVAAAANGSSLCVAKPRADPLNWGKAAEELSGSHLDAVKRMVEEYRRPVVTIEGASLTIAQVAAVASAGAARVELDESARGRVKASSDWVMNSMMNGTDSYGVTTGFGATSHRRTKEGGALQRELIRFLNAGAFGNGDDGHVLPAAATRAAMLVRINTLLQGYSGIRFEILETIATLLNANVTPCLPLRGTITASGDLVPLSYIAGLVTGRPNSVAVTPDGRKVDAAEAFKIAGIQHGFFELQPKEGLAMVNGTAVGSGLASMVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAIDVLKLMSSTFLIALCQAIDLRHLEENVRSAVKGCVTTVARKTLSTSATGDLHKARFCEKDLLQAIDREAVFAYADDPCSANYPLMQKMRAVLIEHALANGEAERNVDTSVFAKVATFEEELRVALPREVEAARAAVENGTAAKANRITECRSYPLYRFVREELGTEYLTGEKTRSPGEEVNKVFVAMNQGKHIDALLECLKEWNGEPLPIC

SEQ ID NO: 18 - protein, 713 aa, Hordeum vulgare
  MISC_FEATURE (1)..(713): Phenylalanine ammonia lyase
MECENAHVAANGDGLCVAQPARADPLNWGKAAEELSGSHLDAVKRMVEEYRKPVVTMEGASLTIAMVAAVAAGNDTRVELDESARGRVKESSDWVMNSMMNGTDSYGVTTGFGATSHRRTKEGGALQRELIRFLNAGAFGTGTDGHVLPAATTRAAMLVRVNTLLQGYSGIRFEILETIATLLNANVTPCLPLRGTITASGDLVPLSYIAGLVTGRPNSVATAPDGTKVNAAEAFKIAGIQHGFFELQPKEGLAMVNGTAVGSGLASMVLFEANVLSLLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDSNGHLHNARFCEKDLLLTIDREAVFAYADDPCSANYPLMQKMRAVLVEHALANGEAEHDVETSVFAKLATFEQEVRAVLPKEVEAARSAVENGTAAQQNRITECRSYPLYRFVRKELGTEYLTGEKTRSPGEEVDKVFVAMNQGKHIDALLECLKEWNGEPLPIC

SEQ ID NO: 19 - protein, 716 aa, Oryza brachyantha
  MISC_FEATURE (1)..(716): Phenylalanine ammonia lyase
MECENGHVAVAAAANGSGLCVAEPCADPLNWGKAAEELSGSHLDAVKRMVEEYRRPVVTIEGASLTIAQVAAGAAVGAARVELDESARGCVKASSDWVMNSMMNGTDSYGVTTGFGATSHRRTKEGGALQRELIRFLNAGAFGNGDDGHVLPASATRAAMLVRINTLLQGYSGIRFEILETIATLLNANVTPCLPLRGTITASGDLVPLSYIAGLVTGRPNSVAVTADGKKVGAAEAFKIAGIQHGFFELQPKEGLAMVNGTAVGSGLASMVLFEANILGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAIDVLKLMSSTFLIALCQAIDLRHLEENVKSAVKSCVTTVARKTLSTTATGDLHKARFCEKDLLQAIDREAVFAYADDPCSANYPLMQKMRAVLVEHALANGEAERNVDTSVFAKLATFEEELRAALPREVEAARAAVENGTAAKAKRITECRSYPLYRFVREELGTEYLTGEKTRSPGEEVNKVFVAMNQGKHIDALLECLKEWNGEPLPIC

SEQ ID NO: 20 - protein, 715 aa, Brachypodium distachyon
  MISC_FEATURE (1)..(715): Phenylalanine ammonia lyase
MEYENGHAATYGDGLCVAAPLAPRADPLNWGKAAEELSGSHLDAVKRMVEEYRRPVVKMEGASLTIAQVAAVAAGAEARVELDESARGRVKESSDWVMNSMMNGTDSYGVTTGFGATSHRRTKEGGALQRELIRFLNAGAFGTGEDGHVLPAAATRAAMLVRVNTLLQGYSGIRFEILETIATLLNANVTPCLPLRGTITASGDLVPLSYIAGLVTGRPNSVATAPDGRKVNAAEAFKIAGIQHGFFELQPKEGLAMVNGTAVGSGLASMVLFEANILGVLAEVLSAVFCEVMNGKPEFTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVRSAVKNCVTTVARKTLSTNVNGHLHNARFCEKDLLLTIDREAVFAYADDPCSANYPLMQKMRAVLVEHALANGEAERDVETSVFAKLAAFEQELRAVLPKEVEAARAAVENGTATKQNRIAECRSYPLYRFVREELGTEYLTGEKTRSPGEEVDKVFVAMNQGKHIDALLECLKEWNGEPLPLC

SEQ ID NO: 21 - protein, 713 aa, Bambusa oldhamii
  MISC_FEATURE (1)..(713): Phenylalanine ammonia lyase
MECENGHVAANVSDLCMAKPPRADPLNWGKAAEELSGSHLDAVKRMVDEYRRPVVRIEGASLTIAQVAAVAAAGEARVELDESARGRVKESSDWVMNSMMNGTDSYGVTTGFGATSHRRTKEGGALQRELIRFLNAGALDTGDDGHVLPAAATRAAMLVRINTLLQGYSGIRFEILETIAALLNANVTPCLPLRGTITASGDLVPLSYIAGLVTGRPNSVAVAPDGRKVNAADAFKIAGIQHGFFELQPKEGLAMVNGTAVGSGPASMVLFEANILGVLAEVLSAVFCEVMNGKPEYTDHLTHKLKHYPGQIEAAAIMEHTLEGSSYMMLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDLYNNGLPSNLSGGRNPSLDYGFKGAEIAMASYCSELQFLANPVTNHVQSAEQHNQDVNSLGLISSRKTGEATDILKLMSSTFLIALCQAIDLRHLEENVKNAVKNCVTTVARKTLSTSATGDLHNARFCEKDLLKAIDREAVFAYADDPCSANYPLMQKMRAVLVEHALANGEAESNVDTSVFAKVATFEEELRAMLPREVEAARAAVENGTAAKQNGITECRSYPLYRFVREELGTEYLTGEKARSPGEEVNKVFVALNQGKHIDALLECLKEWNGEPLPIC

SEQ ID NO: 22 - protein, 890 aa, Aegilops tauschii
  MISC_FEATURE (1)..(890): Phenylalanine ammonia lyase
MECENGHVAANGDGLCVAQPARADPLNWGKAAEELSGSHLDAVNRMVEEYRKPVVLMEGARLTLAMVAAVAAGSDTRVELDESARGRVKESSDWVMNRMMNGTDSYGVTTGFGATSHRRTKEGGALQRELIRFLNAGAFGNGNDGHVLPAAATRAAMLVRVNTLLQGYSGIRFEILETIATLLNANVTPCLPLRGTITASGDLVPLSYIAGLVTGRPNSMATAPDGTKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTNNNGHLHNARFCEKDLLLTIDREAVFAYADDPCSANYPLMQKMRAVLVEHALANGEAERDVETSVFAKLAIFEQELRAVLPKEVEAARGAVENGTATQQNRIAECRSYPLYRFVRKELGTEYLTGEKTRSPGEEVDKVFVAMNQGKHIDALLECLKGWNDWCKCTSISRKGSTRWEETAWTCRMSLVTETCLKPTMNNLVCVLLRETKRPRLPEDGIKVSPPSLRSGDASIIVGGRVKLPINIIPFSNFENEKRTLPQFPAYSVLGNDSRVSTEHSSQSLASQAFTKKDMWGSSHPEENTTSSERPMDQWQINKLTVDGSRAPLALEEPTRLLCQGKDRVTVF

SEQ ID NO: 23 - protein, 707 aa, Aegilops tauschii
  MISC_FEATURE (1)..(707): Phenylalanine ammonia lyase
MEFENANGLCVAQPARADPLNWGKAAEELSGSHLDAVKRMVEEYRRPVVTMEGASLTIAMVAAVAAGSDTRVELDESARNRVKESSDWVMNSMANGTDSYGVTTGFGATSHRRTKEGGALQRELIRFLNAGVFGTGGHDHVLPAAATRAAMLVRVNTLLQGYSGIRFEILETVAALLNANVTPCLPLRGTITASGDLVPLSYIAGLVTGRANSVATAPDGSKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMALAKKLGELDPLMKPKQDRYALRTSPQWLGPQVEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFMVALCQAIDLRHLEENIKDAVKSCVKMAARKTLSTNNNGHLHNARFCEKDLLLTIDREAVFAYADDPCSSNYPLMQKMRAVLVEHALANGEAERDVETSVFAKLATFEQELRAVLPREVEAARTSVENGTAAQQNRITECRSYPLYRFVRKELGTEYLTGEMTRSPGEEVDKVFVAMNQGKHIDALLECLKEWNGEPLPIC

SEQ ID NO: 24 - protein, 713 aa, Phyllostachys edulis
  MISC_FEATURE (1)..(713): Phenylalanine ammonia lyase
MECENGHVAASGNGLCMAKPPRADPLNWGKAAEELLGSHLDAVKRMVEEYRRPVVRIEGASLTIAQVAAVAAAGEARVELDESSRGRVKESSDWVINSMMNGTDSYGVTTGFGATSHRRTEEGGALQRELIRFLNAGAFGTGDDGHVLPAAATRAAMLVRINTLLQGYSGIRFEILETIATLLNANVTPCLPLRGTITASGDLVPLSYIAGLVTGRPNSVAVAPDGRKVNAAEAFKIAGILNGFFELQPKEGLAMVNGTAVGSGLASMVLFEANILGVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKIMSSTFLVALCQAIDLRHIEENVKSAVKSCVMTVAKKTLSTNSTGDLHVARFCEKDLLKEIDREAVFAYADDPCSANYPLMKKMRTVLVERALANGQAERNVDTSVFAKVATFEEELRAMLPREAEAARAAVENGTAAKPNRITECRSYPLYRFVREELGTEYLTGEKTRSPGEEVNKVFVAMNQGKHIDALLECLKEWNGEPLPIC

SEQ ID NO: 25 - protein, 713 aa, Aegilops tauschii
  MISC_FEATURE (1)..(713): Phenylalanine ammonia lyase
MECENGQVAGNGNSLGVAQPARADPLNWGKAAEQLSGSHLDAVKQMVQEYRRPVVTMEGASLTIAMVTAVAAGSETRVELDESARGRVKESSDWVMNSMANGTDSYGVTTGFGATSHRRTKEGGALQRELIRFLNAGAFGTGGHDHVLPAAATRAAMLVRVNTLLQGYSGIRFEILETVAALLNANVTPCLPLRGTITASGDLVPLSYIAGLVTGRANSMATAPDGSKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMALAKKLGELDPLMKPKQDRYALRTSPQWLGPQVEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFMVALCQAIDLRHLEENVKDAVKSCVKMAARKTLSTTNNGHLHNARFCEKALLLTIDREAVFAYADDPCSANYPLMQKMRAVLVEHSLANGEAELDMETSVFAKLAAFEQELRAVLPKEVEAAWTSVENGTAAQQNRITECRSYPLYRLVREELGTEYLTGEKTRSPGEEVDKVFVAMNQGKHIDALLECLKEWNGEPLPIC

SEQ ID NO: 26 - protein, 688 aa, Sorghum bicolor
  MISC_FEATURE (1)..(688): Phenylalanine ammonia lyase
MECENGHAAGASGNGVCLATPRAADPLNWGKAAEDLTGSHLEAVKRMVEEYRRPLVKIEGASLTVAQVAAVAAAGEARVELDESARGRVKASSDWVMNSMMNGTDSYGVTTGFGATSHRRTKEGGALQRELIRFLNAGAFGTGDDGHVLPAAATRAAMLVRINTLLQGYSGIRFEILETIAALLNANVTPCLPLRGTITASGDLVPLSYIAGLVTGRPNSTAVAPDGRKVGAAEAFKIAGIQHGFFELQPKEGLAMVNGTAVGSGLASMVLFEANVLAVLAEVMSAVFCEVMNGKPEYTDHLTHKLKHHPGQIESAAIMEHILDGSSYMMLAKKMGELDPLMKPKQDRYALRTSPQWLGPQIEVIRAATKSIEREINSVNDNPLIDVSRGKALHGGNFQGTPIGVSMDNTRLAVAAIGKLMFAQFSELGAEIAMASYCSELQFLANPVTNHVQSAEQHNQDVNSLGLISSRKTAEAVDVLKLMSSTFLIALCQAVDLRHLEENLKSAVKSCVTTVAKKTLSTSATGGLHNARFCEKDLLTAIDREAVFAYADDPCSANYPLMQKMRSVLVEHALANGEAERDPETSVFAKVATFEEELRAALPREVDAARAAVENGTAAVPNRIAECRSYPLYRFVREELGTEYLTGEKTRSPGEEVNKVFVAMNLGKHIDAVLECLKEWNGEPLPIC

SEQ ID NO: 27 - protein, 714 aa, Aegilops tauschii
  MISC_FEATURE (1)..(714): Phenylalanine ammonia lyase
MEYENRGHVAANDDGLCVVQPARADPLNWGKAAEELSGSHLDAVKRMVEEYRRPVVTMEGASLTIAMVAAVAAGSDTRVELDESARGRVKESSDWVMNSMANGTDSYGVTTGFGATSHRRTKEGGALQRELIRFLNAGAFGNGGHEHVLPAAATRAAMLVRVNTLLQGYSGIRFEILETVAALLNANVTPCLPLRGTITASGDLVPLSYIAGLVTGRANSVATAPDGSKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMALAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDLYNNGLPSNLSGGRNPSLDYGFKGAEIAMASYCSELQFLGNPVTNHVQSAEQHNQDVNSLGLISSRKTAEAIDILKLMSSTFMVALCQAIDLRHLEENVKDAVKSCVKMTARKTLSTTNNGHLHNARFCEKDLLLTIDREAVFAYADDPCSANYPLMQKMRAVLVEHALANGEAEHDMETSVFAKLAAFEQELRAVLPKEVEAARSSVENGTATQHNRITGCRSYPLYRFVRKELGTEYLTGEKTRSPGEEVDKVFVAMNQGKHIDALLECLEEWNGEPLPLC

SEQ ID NO: 28 - protein, 716 aa, Oryza brachyantha
  MISC_FEATURE (1)..(716): Phenylalanine ammonia lyase
MECETGLVRSLNGEGLCMSAPAPRADPLNWGKAADELAGSHLEEVKRMVEDFRQPLVRIEGASLTIAQVAAVATGAGDARVELDESARGRVKASSDWVMSSMMNGTDSYGVTTGFGATSHRRTKEGGALQRELIRFLNAGAFGTGTDGHVLPAEATRAAMLVRINTLLQGYSGIRFEILEAIAKLLNANVTPCLPLRGTITASGDLVPLSYIAGLITGRQNSLAVAPDGSKVTAAEAFKIAGIEHGFFELQPKEGLAMVNGTAVGSGLASTVLFEANVLGILAEVLSAVFCEVMTGKPEYTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDFYNNGLPSNLSGGRNPSLDYGFKGAEIAMASYCSELQFLGNPVTNHVQSAEQHNQDVNSLGLISSRKTAEAVDILKLMSSTFLIALCQAIDLRHLEENMKTAVKNCVMQVAKKSLSLNHMGGLHIARFCEKDLLTAIDREAVFAYADDPCSANYPLMQKLRAVLIEHALANGDAERVLETSIFAKVAEFEQHLRAALPKEVEAARAAVENGTPLVPNRIKDCRSYPLYRFVREEVGTEYLTGEKTRSPGEELNKVLVAINQGKHIDPLLECLKEWNGAPLPLC

SEQ ID NO: 29 - protein, 700 aa, Triticum aestivum
  MISC_FEATURE (1)..(700): Phenylalanine ammonia lyase
MACAWRSRSRADPLNWGKAAEELSGSHLEAVKRMVEEYRKPVVTMEGATTIAMVAAVAAGSDTRVELDESARGRVKESSDWVMNSMMNGTDSYGVTTGFGATSHRRTKEGGALQRELIRFLNAGAFGTGTDGHVLPAAATRAAMLVRVNTLLQGYSGIRFEILETIATLLNANVTPCLPLRGTITASGDLVPLSYIAGLVTGRPNSMATAPDGSKVNAAEAFKIAGIQHGFFELQPKEGLAMVNGTAVGSGLASMVLFEANVLSLLAEVLSGVFCEVMNGKPEFTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDNNGHLHNARFCEKDLLLTIDREAVFAYADDPCSANYPLMQKMRAVLVEHALANGEAEAHVETSVFAKLAMFEQELRAVLPKEVEAARSAVENGTAAQQNRIAECRSYPLYRFVRKELGTEYLTGEKTRSPGEEVDKVFVAMNQGKHIDALLECLKEWNGEPLPLC

SEQ ID NO: 30 - protein, 707 aa, Hordeum vulgare
  MISC_FEATURE (1)..(707): Phenylalanine ammonia lyase
MAANGSDGVCVAKPRSADPLNWGKAAQELSGSHLDAVKRMVEEYRRPVVVMEGASLTIAQVAAVATAGGARVELDESARGRVKESSDWVMTSMANGTDSYGVTTGFGATSHRRTKEGGALQRELIRFLNAGAFGTGSDGHVLPAATTRAAMLVRVNTLLQGYSGIRFEILETVATLLNANVTPCLPLRGTITASGDLVPLSYIAGLVTGRPNAVAVAPDGTKVNAAEAFKIAGIQHGFFELQPKEGLAMVNGTAVGSGLASIVLFEANILGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIATIGKLMFAQFSELVNDLYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKNCVTRVARKTLITNGMGGLHNARFCEKDLLQTIDREAVFAYADDPCSANYPLMKKMRAVLVEHALANGEAEHNVETSVFAKVATFEQELYAALPQEVEAARGAVENGTAAEPNRITDCRSYPLYRFVREELGTVYLTGEKTRSPGEEVDKVFVAMNQGKHIDALLECLKEWNGEPLPIC

SEQ ID NO: 31 - protein, 707 aa, Hordeum vulgare
  MISC_FEATURE (1)..(707): Phenylalanine ammonia lyase
MAANGNDGLCVAEPRSADPLNWGKAAAELSGSHLDAVKRMVEEYRRPVVVMEGASLTIAQVAAVAAAGGARVELDESARGRVKESSDWVMTSMANGTDSYGVTTGFGATSHRRTKEGGALQRELIRFLNAGAFGTGTDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKSCVTRVARKTLITNDMGGLHNARFCEKDLLQTIDREAVFAYADDPCSANYPLMKKMRAVLVEHALANGEAERNVETSVFAKVAKFEQELCATLPQEVEAARGAVENGTAAEPNRIVDCRSYPLYRFVREELGTVYLTGEKTRSPGEEVDKVFVAMNQGKHIDALLECLKEWNGEPLPLC

SEQ ID NO: 32 - protein, 712 aa, Phyllostachys edulis
  MISC_FEATURE (1)..(712): Phenylalanine ammonia lyase
MECENGHAAANGNGLCMATPRADPLNWGKAAEELMGSHLDEVKRMVTEYRQPVVKIEGASLRIAQVAAVAAAGEAKVELDESARERVKASSDWVMNSMMNGTDSYGVTTGFGATSHRRTKEGGALQRELIRFLNAGAFGTGTDSHVLPAAATRAAMLVRINTLLQGYSGIRFEILEAIAKLLNANVTPCLPLRGTITASGDLVPLSYIAGLVTGRENSVAVTPDGRKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHIEENVKSAVKSCVMTVAKKTLSTNSTGDLHVARFCEKDLLKEIDSEAVFAYADDPCSNNYPLMKKMRNVLVERALANGMAEFNAETSVFAKVAQFEEELRATLPRAVEAARTAVENGTAALPNRITECRSYPLYRFVREELGTAYLTGEKTRSPGEELNKVLVAINQGKHIDPLLECLNEWNGEPLPIC

SEQ ID NO: 33 - protein, 707 aa, Hordeum vulgare
  MISC_FEATURE (1)..(707): Phenylalanine ammonia lyase
MAANGNDGLCVAEPRSADPLNWGKAAAELSGSHLDAVKRMVEEYRRPVVVMEGASLTIAQVAAVAAADGARVELDESARGRVKESSDWVMTSMANGTDSYGVTTGFGATSHRRTKEGGALQRELIRFLNAGAFGTGTDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKSCVTRVARKTLITNDMGGLHNARFCEKDLLQTIDREAVFAYADDPCSANYPLMKKMRAVLVEHALANGEAERNVETSVFAKVAKFEQELCATLPQEVEAARGAVENGTAAEPNRIVDCRSYPLYRFVREELGTVYLTGEKTRSPGEEVDKVFVAMNQGKHIDALLECLKEWNGEPLPLC

SEQ ID NO: 34 - protein, 707 aa, Aegilops tauschii
  MISC_FEATURE (1)..(707): Phenylalanine ammonia lyase
MAANGSDGICVAQPRSADPLNWGKAAEELSGSHLDAVKRMVEEYRRPVVVMEGASLTIAQVAAVAAADGARVELDESARGRVKESSDWVMTSMANGTDSYGVTTGFGATSYRRTKEGGALQRELIRFLNAGAFGTGSDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANVLGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAVAAIGKLMFAQFSELVNDFYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKNCVTRVARKTLITNDMGGLHNARFCEKDLLQTIDREAVFAYADDPCSANYPLMKKMRAVLVEHALANGEAERNVETSVFAKVAKFEQEVCATLPQEVEAARGAVENGTAAEPNRITDCRSYPLYRFVREELGTVYLTGEKTRSPGEEVDKVFIAMNQGKHIDALLECLKEWNGEPLPIC

SEQ ID NO: 35 - protein, 707 aa, Hordeum vulgare
  MISC_FEATURE (1)..(707): Phenylalanine ammonia lyase
MAANGNDGLCVAKPRSADPLNWGKAAEELSGSHLDAVKRMVEEYRRPVVVMEGASLTIAQVAAVAAAGGASVELDESARGRVKESSDWVMASMANGVDSYGVTTGFGATSHRRTKEGGARQRELIRFLNTGAFGTGTDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANILGVLAEVLSAVFCEVMNGKSEYTDHLTHKLKHHPGQMEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKNCVTRVARKTLITNDMGGLHNARFCEKDLLQTIDREAVFAYADDPCSANYPLMKKMRAVLVEHALANGEAERNAETSVFAKVATFEQELCAALPQEVEAARGAVENGTATEPNRIADCRSYPLYRFVRKELGTVYLTGEKTRSPGEEVDKVFIAMNQGKHIDALLECLKEWNGEPLPIC

SEQ ID NO: 36 - protein, 707 aa, Aegilops tauschii
  MISC_FEATURE (1)..(707): Phenylalanine ammonia lyase
MATNGNDGLCVAKPRSADPLNWGKAAEELSGSHLDAVKRMVEEYRRPVVVMEGASLTIAQVAAVAAADGARVELDESARGRVKESSDWVMTSMANGTDSYGVTTGFGATSHRRTKEGGALQRELIRFLNAGAFGTGSDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANIFGVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISARKTAEAIDILKLMSSTFLVALCQAIDLRHLEENVKNAVKNCVTRVARKTLITNDMGGLHNARFCEKDLLQTIDREAVFAYADDPCSANYPLMKKMRAVLVEHALANGEAEHNVETSVFAKVAKFEQELCATLPQKVEAARGAVENGTAAEPNRIVDCRSYPLYRFVREELGTVYLTGEKTRSPGEEVDKVFVAMNQGKHIDALLECLKEWNGEPLPIC

SEQ ID NO: 37 - protein, 715 aa, Zea mays
  MISC_FEATURE (1)..(715): Phenylalanine ammonia lyase
MECENGRGVAATNSDSLCMATPRADPLNWGKAAEELMGSHLDEVKRMVAEYRQPLVKIEGASLSIAQVAAVATGAGEARVELDESARSRVKASSDWVMTSMMNGTDSYGVTTGFGATSHRRTKEGGALQRELIRFLNAGAFGTGADGHVLPAETTRAAMLVRINTLLQGYSGIRFEILEAIVKLLNANVTPCLPLRGTVTASGDLVPLSYIAGLVTGRENSVAVAPDGSKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKKTLSTNSTGGLHVARFCEKDLLQEIEREAVFAYADDPCSANYPLMKKLRNVLVERALANGAAEFNAETSVFAKVAQFEEDLRAALPKAVEAARAAVENGTAGIPNRIAECRSYPLYRFVREELGAVYLTGEKTRSPGEELNKVLVAINQGKHIDPLLECLKEWNGEPLPIC

SEQ ID NO: 38 - protein, 713 aa, Oryza sativa
  MISC_FEATURE (1)..(713): Phenylalanine ammonia lyase
MECENGRVSANGMSGLCVAAPRADPLNWGKATEEMTGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIAKLLNANVTPCLPLRGTITASGDLVPLSYIAGLVTGRENAVAVAPDGSKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKHAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLIALCQAVDLRHIEENVKSAVKSCVMTVAKKTLSTNSTGDLHVARFCEKDLLKEIDREAVFAYADDPCSHNYPLMKKLRNVLVERALANGAAEFNADTSVFAKVAQFEEELRATLPGAIEAARAAVENGTAAIPSRITECRSYPLYRFVREELGTKYLTGEKTRSPGEELNKVLVAINEGKHIDPLLECLKEWNGEPLPIC

SEQ ID NO: 39 - protein, 714 aa, Setaria italica
  MISC_FEATURE (1)..(714): Phenyalanine ammonia lyase
MECENGRVAAANGDGLCMATPRADPLNWGKAAEELMGSHLDEVKRMVADYRQPLVKIEGASLNIAQVAAVANGAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLALAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMTSTFLIALCQAVDLRHIEENVKSAVKGCVMTVAKKTLSTNSAGGLHVARFCEKDLLQEIEREAVFAYADDPCSANYPLMKKLRNVLVERALANGTAEFNAETSVLAKVAQFEEELRAALPKAVEAARAAVENGTAAIPNRITECRSYPLYRFVREELGAVYLTGEKTRSPGEELNKVLVAINQGKHIDPLLECLKEWNGEPLPIS

SEQ ID NO: 40 - protein, 708 aa, Aegilops tauschii
  MISC_FEATURE (1)..(708): Phenylalanine ammonia lyase
MAANGNDGLCVAEPRSAADPLNWGKAAEELSGSHLDAVKRMVEEYRRPVVVMEGASLTIAQVAAVAAAGGARVELDESARGRVKESSDWVMASMANGTDSYGVTTGFGATSHRRTKEGGALQRELIRFLNAGGFGTGGDGHVLPAATTRAAMLVRVNTLLQGYSGIRFEILETIATLLNANVTPCLPLRGTITASGDLVPLSYIAGLVTGRPNAVAVAPDGTKVNAAEAFKIAGIQHGFFELQPKEGLAMVNGTAVGSGLASIVLFEANILAVLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKNCVTRVARKTLITNDMGGLHNARFCEKDLLQTIDREAVFAYADDPCSANYPLMKKMRAVLVEHALANGEAERNKETSVFAKVATFEQELCAALPQEVEAARGAVENGTAAEPNRIADCRSYPLYRFVRKELGTVYLTGEKTRSPGEEVDKVFIAMNQGKHINALLECLKEWNDEPLPIC

SEQ ID NO: 41 - protein, 713 aa, Oryza sativa
  MISC_FEATURE (1)..(713): Phenylalanine ammonia lyase
MECENGRVSANGMSGLCVAAPRADPLNWGKATEEMTGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIAKLLNANVTPCLPLRGTITASGDLVPLSYIAGLVTGRENAVAVAPDGSKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKHAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTDEAIDILKLMSSTFLIALCQAVDLRHIEENVKSAVKSCVMTVAKKTLSTNSTGDLHVARFCEKDLLKEIDREAVFAYADDPCSHNYPLMKKLRNVLVERALANGAAEFNADTSVFAKVAQFEEELRATLPGAIEAARAAVENGTAAIPSRITECRSYPLYRFVREELGTKYLTGEKTRSPGEELNKVLVAINEGKHIDPLLECLKEWNGEPLPIC

SEQ ID NO: 42 - protein, 713 aa, Setaria italica
  MISC_FEATURE (1)..(713): Phenylalanine ammonia lyase
MACEKSNVAANGDGLCMATPRADPLNWGKAAEELMGSHLDEVKRMVADYRQPLVKIEGASLNIAQVAAVANGAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKIMSSTFLIALCQAVDLRHIEENVKSAVKSCVMTVAKKTLSTNSTGGLHVARFCEKDLLQEIEREAVFAYADDPCSANYPLMKKLRNVLVERALANGTAEFNAETSVLAKVAQFEEELRAALPKAVEAARAAVENGTAAIPIRITECRSYPLYRFVREELGAVYLTGEKTRSPGEELNKVLVAINLGKHIDPLLECLKEWNGEPLPIC

SEQ ID NO: 43 - protein, 718 aa, Oryza sativa
  MISC_FEATURE (1)..(718): Phenylalanine ammonia lyase
MECETGLVRSLNGDGLCMSSVSAPPRADPLNWGKAADELAGSHLDEVKRMVEDFRQPLVKIEGASLTIAQVAAVAAGAGDARVELDESARGRVKASSDWVMNSMMNGTDSYGVTTGFGATSHRRTKEGGALQRELIRFLNAGAFGTGTDGHVLPAEATRAAMLVRINTLLQGYSGIRFEILEAITKLLNANVTPCLPLRGTITASGDLVPLSYIAGLITGRQNSVAVAPDGRKVTAAEAFKIAGIEHGFFELQPKEGLAMVNGTAVGSGLASTVLFEANVLAILAEVLSAVFCEVMTGKPEYTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLIALCQAIDLRHLEENMKTAVKNCVMQVAKKSLSMNHMGGLHIARFCEKDLLTAIDREAVFAYADDPCSANYPLMQKLRAVLIEHALANGDAERVLETSIFAKVAEFEQHVRAALPKEVEAARAAVENGTPLVPNRIKECRSYPLYRFVREEVGTEYLTGEKTRSPGEELNKVLVAINERKHIDPLLECLKEWNGAPLPLC

SEQ ID NO: 44 - protein, 712 aa, Brachypodium distachyon
  MISC_FEATURE (1)..(712): Phenylalanine ammonia lyase
MECENGQFAANGTGLCMATPRADPLNWGKAAEELTGSHLDEVKRMVAEYRKPVVTIEGATLSIAKVAAVAAAGEAKVELDESARERVKASSDWVMNSMANGVDSYGVTTGFGATSHRRTKEGGALQRELIRFLNAGAFGTGSDGHVLPAGATRAAMLVRINTLLQGYSGIRFEILEAIAKLLNANVTPCLPLRGTITASGDLVPLSYIAGLVTGRENSVAVTPDGRKVNAAEAFKIAGIHGGFFELQPKEGLAMVNGTAVGSGLASTVLFEANILAVLAEVISAVFCEVMNGKPEFTDHLTHKLKHHPGQIEAAAIMEHILEGSSYMKLAKKLGDLDPLMKPKQDRYALRTSPQWLGPQIEVIRAATKSIEREINSVNDNPLIDVSRGKAIHGGNFQGTPIGVSMDNTRLALAAIGKLMFAQFSELVNDFYNNGLPSNLSGSRNPSLDYGFKGAEIAMASYCSELQFLGNPVTNHVQSAEQHNQDVNSLGLISSRKTAEAVEILKLMSSTFLVALCQAIDLRHIEENVKSAVKSCVMTVAKRTLSTNSTGGLHVARFCEKDLLQEIEREAVFAYADDPCSANYPLMKKLRGVLVERALSNGKAEFNAETSVFAKVAQFEEELRTALPKAVEAARSAVESGTAATPNRIKECRSYPLYRFVREELGTAYLTGEKTRSPGEELNKVLVAINQGKHIDPLLECLKEWNGEPLPIC

SEQ ID NO: 45 - protein, 713 aa, Setaria italica
  MISC_FEATURE (1)..(713): Phenylalanine ammonia lyase
MACEKSNVAANGDGLCMATPRADPLNWGKAAEELMGSHLDEVKRMVADYRQPLVKIEGASLNIAQVAAVANGAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKIMSSTFLIALCQAVDLRHIEENVKSAVKSCVMTVAKKTLSTNSTGGLHVARFCEKDLLQEIEREAVFAYADDPCSANYPLMKKLRNVLVERALANGTAEFNAETSVLAKVAQFEEELRAALPKAVEAARAAVENGTAAIPIRITECRSYPLYRFVREELGAVYLTGEKTRSPGEELNKVLVAINQGKHIDPLLECLKEWNGEPLPIC

SEQ ID NO: 46 - protein, 712 aa, Phyllostachys parvifolia
  MISC_FEATURE (1)..(712): Phenylalanine ammonia lyase
MECENGHVAANGNGLCMATPRADPLNWGKAAEELMGCHLDEVKRMVTEYRQPVVKIEGASLRIAQVAAVAAAGKAKVELDESARERVKASSDWVMDSMMNGTDSYGVTTGFGATSHRRTKEGGALQRELIRFLNAGAFGTGSDGHVLSADATRAAMLVRINTLLQGYSGIRFEILEAITKLLNANVTPCLPLRGTVTASGDLVPLSYIAGLVTGRENSVAVAPDGTKVNAAEAFKIAGIQGGLFELQPKEGLAMVNGTAVGSGLASTVLFEANILAILDEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLGNPVTNHVESAEQHNQDVNSLGLISSRKTAEAIDILKIMSSTFLVALCQAIDLRHTEENVKSAVKSCVMTVAKKTLSTNSTGDLHVARFCEKDLLKEIDREAVFAYADDPCSPNYPLMKKLRNVLVESALANGMAEFNAETSVFAKVAQFEEELRATLPRAVEAARTAVENGTAALPNRITECRSYPLYRFVREELGTAYLTGEKTRSPGEELNKVLVAINQGKHIDPLLECLNEWNGEPLPIC

SEQ ID NO: 47 - protein, 712 aa, Bambusa oldhamii
  MISC_FEATURE (1)..(712): Phenylalanine ammonia lyase
MPREDGHVAANGNGLCMAAPRADPLNWGKAAEELMGSHLDEVKRMVAEYRQPVVKIEGASLRIAQVAAVAVAGDAKVELDESARERVKASSDWVMNSMMNGTDSYGVTTGFGATSHRRTKEGGALQRELIRFLNAGAFGTGCDGHVLPAEATRAAMLVRINTLLQGYSGIRFEILEAITKLLNANVTPCLPLRGTVTASGDLVPLSYIAGLVTGRENSVAVAPDGRKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGDLDPLMKPKQDRYALRTSPQWLGPQIEVIRAATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKIMSSTFLVALCQAIDLRHIEENVKSAVKSCVMTVAKKTPSTNSTGDLHVARFCEKDLLKEIDREAVFAYADDPCSPNYPLMKKLRSVLVESALANGMAEFNAETSIFARVALFEEELRAALPRAVEAARASVENGTAAAPNRITECRSYPLYRFVREELGTEYLTGEKTRSPGEELNKVLLAINQGKHIDPLLECLKEWNGEPLPIC

SEQ ID NO: 48 - protein, 718 aa, Setaria italica
  MISC_FEATURE (1)..(718): Phenylalanine ammonia lyase
MECETGLVRSLHGDGLCMSAQAAAPRADPLNWGKAAEDLSGSHLDEVKRMVAEFREPLVKIQGASLSIAQVAAVAAGAGEARVELDESARERVKASSDWVMNSMMNGTDSYGVTTGFGATSHRRTKEGGALQRELIRFLNAGAFGTGADGHVLPAEATRAAMLVRINTLLQGYSGIRFEILETIAKLLNANVTPCLPLRGTITASGDLVPLSYIAGLITGRQNSVAVAPDGRKVDAAEAFKIAGIEHGFFELQPKEGLAMVNGTAVGSGLASTVLFEANVLAIMAEVISAVFCEVMTGKPEFTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDFYNNGLPSNLSGGRNPSLDYGFKGAEIAMASYCSELQFLGNPVTNHVQSAEQHNQDVNSLGLISSRKTAEAIEILKLMTSTFLIALCQAIDLRHLEENMKAAVKNCVTQVAKKTLSMNAMGGLHIARFCEKDLQTAIDREAVFAYADDPCSPNYPLMQKLRAVLIEHALANGDAERVVETSIFAKVAEFEQQVRAALPKEVEAARAAVESGRPMVPNRIKECRSYPLYRFVREELGAEYLTGEKTRSPGEELNKVLVAINERKHIDPLLECLKEWNGEPLPLC

SEQ ID NO: 49 - protein, 717 aa, Sorghum bicolor
  MISC_FEATURE (1)..(717): Phenylalanine ammonia lyase
MASMACENGRVAATNGDGLCMATPRADPLNWGKAAEELMGSHLDEVKRMVAEYRQPLVKIEGASLRIAQVAAVAAGAGEARVELDESARGRVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKKTLSTNSTGGLHVARFCEKDLLQEIEREAVFAYADDPCSANYPLMKKLRNVLVERALANGAAEFDAETSVFAKVAQFEEELRAALPKAVEAARAAVENGTAAIPNRITECRSYPLYRFVRQEVGAVYLTGEKTRSPGEELNKVLVAINQGKHIDPLLECLKEWNGEPLPIC

SEQ ID NO: 50 - protein, 714 aa, Sorghum bicolor
  MISC_FEATURE (1)..(714): Phenylalanine ammonia lyase
MACENGRVAATNGDGLCMATPRADPLNWGKAAEELMGSHLDEVKRMVAEYRQPLVKIEGASLRIAQVAAVAAGAGEARVELDESARGRVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKKTLSTNSTGGLHVARFCEKDLLQEIEREAVFAYADDPCSANYPLMKKLRNVLVERALANGAAEFDAETSVFAKVAQFEEELRAALPKAVEAARAAVENGTAAIPNRITECRSYPLYRFVRQEVGAVYLTGEKTRSPGEELNKVLVAINQGKHIDPLLECLKEWNGEPLPIC

SEQ ID NO: 51 - protein, 712 aa, Phyllostachys dulcis
  MISC_FEATURE (1)..(712): Phenylalanine ammonia lyase
MECENGHVAANGNGLCMATPRADPLNWGKAAEELMGSHLDEVKRMVTEYRQPVVKIEGASLRIAQVAAVAAAGKAKVELDESARERVKASSDWVMDSMMNGTDSYGVTTGFGATSHRRTKEGGALQRELIRFLNAGAFGTGSDGHVLSADATRAAMLVRINTLLQGYSGIRFEILEAITKLLNANVTPCLPLRGTVTASGDLVPLSYIAGLVTGRENSVAVAPDGTKVNAAEAFKIAGIQGGFFELQPKEGLAMVNGTAVGSGLASTVLLEANILAILVEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRNKALHGGNFQSTPIGVSMDNTRLAIAAIGKLMFAQFSELVNDFYNNGLPSNLSGGRNPSLDYGFKGAEIAMASYCSELQFLGNPVTNHVESAEQHNQDVNSLGLISSRKTAEAIDILKIMSSTFLVALCQAIDLRHTEENVKSAVKSCVMTVAKKTLSTNSTGDLHVARFCEKDLLKEIDREAVFAYADDPCSPNYPLMKKLRNVLVESALANGMVEFNAETSVFAKVAQFEEELRATLPRAVEAARTAVENGTAALPNRITECRSYPLYRSVREELGTAYLTGEKTRSPGEELNKVLVAINQGKHIDPLLECLNEWNSEPLPIC

SEQ ID NO: 52 - protein, 712 aa, Phyllostachys angusta
  MISC_FEATURE (1)..(712): Phenylalanine ammonia lyase
MECENGHPAANGNGLCMATPRADPLNWGKAAEELMGSHLDEVKRMVTEYRQPVVKIEGASLRIAQVAAVAAAGKAKVELDESARERVKASSDWVMDSMMNGTDSYGVTTGFGATSHRRTKEGGALQRELIRFLNAGAFGTGSDGHVLSADATRAAMLVRINTLLQGYSGIRFEILEAITKLLNANVTPCLPLRGTVTASGDLVPLSYIAGLVTGRENSVAVAPDGRKVNAAEAFKIAGIQGGFFELQPKEGLAMVNGTAVGSGLASTVLFEANILAILVEVLSAVFCEVMNGKPEYTDHLTHKLKHHPGQIEAAAIMEHILEGSSYMKLAKKLGELDPLMKPKQDRYALRTSPQRLGPQIEVIRAATKSIEREINSVNDNPLIDVSRNKALHGGNFQGTPIGVSMDSTRLAIAAIGKLMFAQISELVNDFYNNGLPSNLSGGRNPSLDYGFKGAEIAMASYCSELLFLGNPVTNHVESAEQHNQDVNSLGLISSRKTAEAIDILKIMSSTFLVALCQAIDLRHTEENVKSAVKSCVMTVAKKTLSTNSTGDLHVARFCEKDLLKEIDREAVFAYADDPCSPNYPLMKKLRNVLVESALANGMAEFNAETSVFAKVAQFEEELRATLPRAVEAARTAVENGTAALPNRITECRSYPLYRFVREELGTAYLTGEKTRSPGEELNKVLVAINQGKHIDPLLECLNEWNGEPLPIC

SEQ ID NO: 53 - protein, 718 aa, Zea mays
  MISC_FEATURE (1)..(718): Phenylalanine ammonia lyase
MESEAGLLVRSSLNGEGLCMPAPRADPLNWGKAAEGLSGSHLDEVKRMVAEFRDPLVKIQGASLSVAQVAAVAVGAGGGEARVELDESARERVRASSDWVMGSMMNGTDSYGVTTGFGATSHRRTKEGGALQRELIRFLNAGAFGTGADGHVLPAEATRAAMLVRVNTLLQGYSGIRFEILEAIAKLLNANVTPCLPLRGTITASGDLVPLSYIAGLITGRQNSMAVAPDGRKVGAAEAFKIAGIEHGFFELQPKEGLAMVNGTAVGSGLASTVLFEANVLAVLAEVISAVFCEVMTGKPEFTDHLTHKLKHHPGQIEAAAVMEHILEGSSYMKLAKRLGELDPLMKPKQDRYALRTSPQWLGPQIEVIRFATKSIEREINSVNDNPLIDVSRGKALHGGNFQGTPIGVSMDNTRLALAAIGKLMFAQFSELVNDYYNNGLPSNLSGGRNPSLDYGFKGAEIAMASYCSELQFLGDPVTNHVQSAEQHNQDVNSLGLISSRKTAEAIDILKLMSSTFLIALCQAIDLRHLEENVKAAVKNCVTQVAKKSLSLNARGGLHNARFCEKDLQTAIDREAVFAYADDPCSPNYALMQKLRAVLVEHALANGDAERDVDTSIFAKVAEFEQQVRAALPKEVEAARAAVENGSPLVPNRIKECRSYPLYRFVREEVGTEYLTGEKTRSPGEELNKVLVAINQRKHIDPLLECLKEWNGEPLPLC

SEQ ID NO: 54 - protein, 714 aa, Sorghum bicolor
  MISC_FEATURE (1)..(714): Phenylalanine ammonia lyase
MACDNGRVAATNGDGLCMATPRADPLNWGKAAEELMGSHLDEVKRMVAEYRQPLVKIEGASLRIAQVAAVAAGAGEARVELDESARGRVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKKTLSTNSTGGLHVARFCEKDLLQEIEREAVFAYADDPCSANYPLMKKLRNVLVERALANGAAEFDAETSVFAKVAQFEEELRAALPKAVEAARAAVENGTAAIPNRITECRSYPLYRFVRQEVGAVYLTGEKTRSPGEELNKVLVAINQGKHIDPLLECLKEWNGEPLPIC

SEQ ID NO: 55 - protein, 713 aa, Oryza brachyantha
  MISC_FEATURE (1)..(713): Phenylalanine ammonia lyase
MACENGQVAADGIDGLCIAAPRADPLNWGKAAEEMAGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLSAEATRAAMLVRINTLLQGYSGIRFEILEAIAKLLNANVTPCLPLRGTVTASGDLVPLSYIAGLVTGRENSVAVAPDGSKVNAAEAFKIAGIQGGFFELQPKEGLAMVNGTAVGSGLASTVLFEANILAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRDKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAVEILKLMSSTFLVALCQAIDLRHIEENVKSAVKSCVMTVARKTLSTSATGGLHAARFCEKDLLQEIDREAVFAYADDPCSANYPLMKKLRGVLVERALANGAAEFNAETSVFAKVAQFEEELRAALPRAVEAARAAVEDGTAATPNRITKCRSYPLYRFVREELGTAYLTGEKTRSPGEELNKVLVAINQGKHIDPLLECLKEWNGEPLPIC

SEQ ID NO: 56 - protein, 712 aa, Pleioblastus maculosoides
  MISC_FEATURE (1)..(712): Phenylalanine ammonia lyase
MECENGHVAANGNGLCMATPRADPLNWGKAAEELMGSHLDEVKRMVTEYRQPVVKIEGASLRIAQVAAVAAAGEAKVELDESARERVKASSDWVMNSMMNGTDSYGVTTGFGATSHRRTKEGGALQRELIRFLNAGAFGTGTDSHVLPAAATRAAMLVRINTLLQGYSGIRFEILEAIAKLLNANVTPCLPLRGTITASGDLVPLSYIAGLVTGRENSVAVTPDGRKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHIEENVKSAVKSCVMTVAKKTLSTNSTGDLHVGRFCEKDLLKEIDCEAVFAYADDPCSPNYPLMKKMRNVLVERALANGMAEFNAETSVFAKVAQFEEELRAALPRAVEAARAAVENGTAALPNRITEGRSYPLYRFVREELGAAYLTGEKTRSPGEELNKVLVAINQGKHIDPLLECLKEWNGEPLPIC

SEQ ID NO: 57 - protein, 716 aa, Oryza sativa
  MISC_FEATURE (1)..(716): Phenylalanine ammonia lyase
MECETGYVAAAADGGLCMEVPRADPLNWGKAAEEMAGSHLDEVKRMVAEYRQPVVRIEGASLRIAQVAAVAGAGDGEAAMVELDESARERVKASSDWVMNSMANGTDSYGVTTGFGATSHRRTKEGGALQRELIRFLNAGAFGTGADGHVLPAGATRAAMLVRINTLLQGYSGIRFEILEAVAKLLNANVTPCLPLRGTITASGDLVPLSYIAGLVTGRENSVAVAPDGRKVNAAEAFKIAGIQGGFFELQPKEGLAMVNGTAVGSGLASTVLFEANVLAILAEVLSAVFCEVMNGKPEYTDHLTHKLKHHPGQIEAAAIMEHILEGSSYMKEAKRLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHIEENVKGAVKTCVMTVAKKTLSTNSTGGLHVARFCEKDLLSEIDREAVFAYADDPCSANYPLMKKLRSVLVERALANGAAEFDAETSVLAKVARFEEELRAALPRAVEAARAAVESGTAAAPNRIAECRSYPLYRFVREELGTAYLTGEKTRSPGEELNKVLVAINQGKHIDPLLECLKEWNGAPLPIC

SEQ ID NO: 58 - protein, 718 aa, Zea mays
  MISC_FEATURE (1)..(718): Phenylalanine ammonia lyase
MESEAGLLVRSSLNGEGLCMPAPRADPLNWGKAAEGLSGSHLDEVKRMVAEFRDPLVKIQGASLSVAQVAAVAVGAGGGEARVELDESARERVRASSDWVMGSMMNGTDSYGVTTGFGATSHRRTKEGGALQRELIRFLNAGAFGTGADGHVLPAEATRAAMLVRVNTLLQGYSGIRFEILEAIAKLLNANVTPCLPLRGTITASGDLVPLSYIAGLITGRQNSVAVDPDGRKVGAAEAFKIAGIEHGFFELQPKEGLAMVNGTAVGSGLASTVLFEANVLAVLAEVISAVFCEVMTGKPEFTDHLTHKLKHHPGQIEAAAVMEHILEGSSYMKLAKRLGELDPLMKPKQDRYALRTSPQWLGPQIEVIRFATKSIEREINSVNDNPLIDVSRGKALHGGNFQGTPIGVSMDNTRLALAAIGKLMFAQFSELVNDYYNNGLPSNLSGGRNPSLDYGFKGAEIAMASYCSELQFLGNPVTNHVQSAEQHNQDVNSLGLISSRKTAEAIDILKLMSSTFLIALCQAIDLRHLEENVKAAVKNCVTQVAKKSLSLNARGGLHNARFCEKDLQTAIDREAVFAYADDPCSPNYALMQKLRAVLVEHALANGDAERDVDTSIFAKVAEFEQQVRAALPKEVEAARAAVENGSPLVPNRIKECRSYPLYRFVREEVGTKYLTGEKTRSPGEELNKVLVAINQRKHIDPLLECLKEWNGEPLPLC

SEQ ID NO: 59 - protein, 704 aa, Zea mays
  MISC_FEATURE (1)..(704): Phenylalanine ammonia lyase
MACDSPCMATPRADPLNWGKAAEELMGSHLDEVKRMVAEYRQPLVKIEGASLSIAQVAAVATGVGEARVELDESARSRVKASSDWVMSSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGSKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNSVTNHVQSAEQHNQDVNSLGLISSRKTAEAIEILKIMSSTFLIALCQAVDLRHIEENVKSAVKSCVMTVAKKTLSTDSTGGLHVARFCEKDLLQEIEREAVFAYADDPCSANYPLMKKLRNVLVERALANGAAEFNAETSVFAKVAQFEEDLRAALPKAVEAARAAVENGTAAIPNRITDCRSYPLYRFVREELGAVYLTGEKTRSPGEELNKVLVAINQGKHIDPLLECLKEWNGEPLPIC

SEQ ID NO: 60 - protein, 718 aa, Sorghum bicolor
  MISC_FEATURE (1)..(718): Phenylalanine ammonia lyase
MECETGLVRSLNGDGLCMSAQAAPRGADPLNWGKAAEDLSGSHLEEVKRMVAEFRDPVVKIQGASLSIAQVAAVAAGAGEARVELDESARERVKASSDWVMSSMMNGTDSYGVTTGFGATSHRRTKEGGALQRELIRFLNAGAFGTGADGHVLPAEATRAAMLVRINTLLQGYSGIRFEILEAIAKLLNANVTPCLPLRGTITASGDLVPLSYIAGLITGRQNSVAVAPDGRKVDAAEAFKIAGIEHGFFELQPKEGLAMVNGTAVGSGLASTVLFEANVLAIMAEVISAVFCEVMTGKPEFTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDYYNNGLPSNLSGGRNPSLDYGFKGAEIAMASYCSELQFLGNPVTNHVQSAEQHNQDVNSLGLISSRKTAEAIDILKLMTSTFLIALCQAIDLRHIEENVKAAVKNCVTQVAKKSLSLNARGGLHNARFCEKDLQTAIDREAVFAYADDPCSPNYPLMQKLRAVLIEHALANGDAERVVETSIFAKVAEFEQQVRAALPKEVEAARAAVESGNPLVPNRIKECRSYPLYRFVREEVGTQYLTGEKTRSPGEELNKVLVAINQRKHVDPLLECLKEWNGEPLPLC

SEQ ID NO: 61 - protein, 712 aa, Phyllostachys prominens
  MISC_FEATURE (1)..(712): Phenylalanine ammonia lyase
MECENGHVAANGNGLCMATPRADPLNWGKAAEELMGCHLDEVKRMVTEYRQPVVKIEGASLRIAQVAAVAAAGEAKVELDESARERVKASSDWVMNSMMNGTDSYGVTTGFGATSHRRTKEGGALQRELIRFLNAGAFGTGTDSHVLPAAATRAAMLVRINTLLQGYSGIRFEILEAIAKLLNANVTPCLPLRGTITASGDLVPLSYIAGLVTGRENSVAVTPDGRKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHIEENVKSAVKSCVMTVAKKTLSTNSTGDLHVGRFCEKDLLKEIDCEAVFAYADDPCSPNYPLMKKMRNVLVERALANGMAEFNAETSVFAKVAQFEEELRAALPRAVEAARAAVENGTAALPNRITEGRSYPLYRFVREELGAAYLTGEKTRSPGEELNKVLVAINQGKHIDPLLECLKEWNGEPLPIC

SEQ ID NO: 62 - protein, 713 aa, Bambusa oldhamii
  MISC_FEATURE (1)..(713): Phenylalanine ammonia lyase
MECENGQVASNGNGLCMATPRADPLNWGKAAEELMGSHLEEVKRMVAEYRQPVVKIEGASLRIAQVAAVAAGAGEAKVQLDDSARGRVKESSDWVMNSMMNGTDSYGVTTGFGATSHRRTKEGGALQRELIRFLNAGAFGTGSDGHVLAAEATRAAMLVRINTLLQGYSGIRFEILEAIAKLLNANVTPCLPLRGTITASGDLVPLSYIAGLVTGRENSVAVAPDGRKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKALHGGNFQGTPIGVSMDNTRLAIAAVGKLMFAQFSELVNDFYNNGLPSNLSGGRNPSLDYGFKGAEIAMASYCSELQFLGNPVTNHVQSAEQHNQDVNSLGLISSRKTAEAIDILKIMSSTFLVALCQAIDLRHIEENVKSAVKSCVMTVAKKTLSTNSTGDLHVARFCEKDLLKEIDREAVFAYADDPCSPNYPLMKKMRNVLVERALANGMAEFNAETSVFAKVAQFEEELRATLPRAVEAARAAVENGTAATPNRITECRSYPLYRFVREELGTAYLTGEKTRSPGEELNKVLLAINQGKHIDPLLECLKEWNGEPLPIN

SEQ ID NO: 63 - protein, 712 aa, Phyllostachys iridescens
  MISC_FEATURE (1)..(712): Phenylalanine ammonia lyase
MECENGHAAANGNGLCMATPRADPLNWGKAAEELMGSHLDEVKRMVTEYRQPVVKIEGASLRIAQVAAVAAAGEAKVELDESARERVKASSDWVMNSMMNGTDSYGVTTGFGATSHRRTKEGGALQRELIRFLNAGAFGTGTDSHVLPAAATRAAMLVRINTLLQGYSGIRFEILEAIAKLLNANVTPCLPLRGTITASGDLVPLSYIAGLVTGRENSVAVTPDGRKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIATASYCSELQFLGNPVTNHVQSAEQHNQDVNSLGLISSRKTAEAIDILKLMSSTFLVALCQAIDLRHIEENVKSAVKSCVMTVAKKTLSTNSTGDLHVGRFCEKDLLKEIDCEAVFAYADDPCSPNYPLMKKMRNVLVERALANGMAEFNAEISVFAKVAQFEEELRAALPRAVEAARAAVENGTAALPNRITEGRSYPLYRFVREELGAAYLTGEKTRSPGEELNKVLVAINQGKHIDPLLECLKEWNGEPLPIC

SEQ ID NO: 64 - protein, 712 aa, Brachypodium distachyon
  MISC_FEATURE (1)..(712): Phenylalanine ammonia lyase
MECENGQFAANGTGLCMATPSADPLNWGKAAEELTGSHLDEVKRMVAEYRKPVVTIEGATLSIAKVAAVAAAGEAKVELDESARERIKASSDWVMNSMMNGTDSYGVTTGFGATSHRRTKEGGALQRELIRFLNAGAFGTGSDGHVLPAGATRAAMLVRINTLLQGYSGIRFEILEAIAKLLNANVTPCLPLRGTITASGDLVPLSYIAGLVTGRENSVAVTPDGRKVNAAEAFKLAGIHGGFFELQPKEGLAMVNGTAVGSGLASTVLFEANILAVLAEVISAVFCEVMNGKPEFTDHLTHKLKHHPGQIEAAAIMEHILEGSSYMKLAKKLGDLDPLMKPKQDRYALRTSPQWLGPQIEVIRAATKSIEREINSVNDNPLIDVSRGKAIHGGNFQGTPIGVSMDNTRLALAAIGKLMFAQFSELVNDFYNNGLPSNLSGSRNPSLDYGFKGAEIAMASYCSELQFLGNPVTNHVQSAEQHNQDVNSLGLISSRKTAEAVEILKLMSSTFLVALCQAIDLRHIEENVKIAVKSCVMTVAKKTLSTNSTGGLHVARFCEKDLLQEIEREAVFAYADDPCSANYPLMKKLRSVLVERALSNGMAEFNAETSVFAKVAQFEEELRTVLPKAVEAARAAVESGTAATPNRIKECRSYPLYRFVREELGTAYLTGEKTRSPGEELNKVLVAINQGKHIDPLLECLKEWNGEPLPIC

SEQ ID NO: 65 - protein, 717 aa, Brachypodium distachyon
  MISC_FEATURE (1)..(717): Phenylalanine ammonia lyase
MECENGLVGSLNGEGLCMSAPPRAAADPLNWAKTAEELAGSHLEEVKKMVAQFRMPLVKIEGATLGIAQVAAVAAGAGEARVELDESARGRVKESSDWVMNSMMNGTDSYGVTTGFGATSHRRTKEGGALQRELIRFLNAGAFGTGTDGHVLPAEATRAAMLVRINTLLQGYSGIRFEILEAITKLLNANVTPCLPLRGTITASGDLVPLSYIAGLITGRQNSVAVAPDGSKVSAAEAFKIAGIEHGFFELQPKEGLAMVNGTAVGSGLASTVLFEANIQAILAEVLSAVFCEVMTGKPEFTDHLTHKLKHHPGQIEAAAIMEHILEGSSYMKEAKKQGELDPLMKPKQDRYALRTSPQWLGPQIEVIRFATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKIMSSTFLIALCQAIDLRHLEENMKTAVRNCVMQVAKKTLSMNAMGGLHIARFCEKDLLTAIDREAVFAYADDPCSPNYPLMQKLRAVLIEHALANGDGERALETSIFAKVAEFEQNLRAALPKEVEAARASVENGTPLAPNRIKDCRSYPLYRFVREELGTEYLTGEKTRSPGEELNKVLVAMNQRKHIDPLLECLKEWNGEPLPLC

SEQ ID NO: 66 - protein, 657 aa, Aegilops tauschii
  MISC_FEATURE (1)..(657): Phenylalanine ammonia lyase
MEGASLTIAMVAAVAAGNDTRVELDESARGRVKESSDWVMNSMMNGTDSYGVTTGFGATSHRRTKEGGALQRELIRFLNAGAFGTGTDGHVLPAAATRAAMLVRVNTLLQGYSGIRFEILETVATLINANVTPCLPLRGTITASGDLVPLSYIAGLVTGRPNSMATAPDGTKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPQIEVIRASTKLIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDTNGHLHNARFCEKDLLLTIDREAVFAYADDPCSANYPLMQKMRAVLVEHALANGEAERDVETSVFAKLATFEQELRAVLPKEVEAARSAVENGTAAQQNRIAECRSYPLYRFVRKELGTEYLTGEKTRSPGEEVDKVFIAMNQGKHIDALLECLKEWNGEPLPLC

SEQ ID NO: 67 - protein, 713 aa, Oryza sativa
  MISC_FEATURE (1)..(713): Phenylalanine ammonia lyase
MACENGQVAADGINGLCMAAPRADPLNWGKAAEEMSGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLSAEATRAAMLVRINTLLQGYSGIRFEILEAITKLLNANVTPCLPLRGTVTASGDLVPLSYIAGLVTGRENSVAVAPDGSKVNAAEAFKIAGIQGGFFELQPKEGLAMVNGTAVGSGLASTVLFEANILAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRDKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAVEILKLMSSTFLVALCQAIDLRHIEENVKSAVKSCVMTVARKTLSTSATGGLHAARFCEKDLLQEIDREAVFAYADDPCSANYPLMKKLRNVLVERALANGAAEFNAETSVFAKVAQFEEELRAALPAAVLAARAAVENGTAATPNRITECRSYPLYRFVREELGTAYLTGEKTRSPGEELNKVLVAINQGKHIDPLLECLKEWNGAPLPIC

SEQ ID NO: 68 - protein, 719 aa, Zea mays
  MISC_FEATURE (1)..(719): Phenylalanine ammonia lyase
MECETGLVRSLNGEGLCMSAAAAAPRADALNWGKAAEDLSGSHLDEVKRMVVEFREPLVRIQGASLSIGQVAAVAAGAGGEARVELDESARGRVKASSDWVMSSMMNGTDSYGVTTGFGATSHRRTKEGGALQRELIRFLNAGAFGTGADGHVLPAEATRAAMLVRINTLLQGYSGIRFEILEAIAKLLNANVTPCLPLRGTITASGDLVPLSYIAGLITGRQNSVAVGPDGRKVGAAEAFRIAGIEHGFFELQPKEGLAMVNGTAVGSGLASTVLFEANVLAVMAEVISAVFCEVMTGKPEFTDHLTHKLKHHPGQIEAAAIMEHVLEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDYYNNGLPSNLSGGRNPSLDYGFKGAEIAMASYCSELQFLGNPVTNHVQSAEQHNQDVNSLGLISSRKTAEAVDILKLMTSTFLIALCQAIDLRHLEENVKAAVKNCVTQVAKKSLSLNARGGLHNARFCEKDLQTAIDREAVFAYADDPCSPNYPLMQKLRAVLVEHALANGDAERAAETSIFAKVAEFEQQVRAALPKEVEAARAAVESGSPLVPNRIRECRSYPLYRFVREDVGTEYLTGERTRSPGEELNKVLVAINQRKHIDPLLECLKEWNGAPLPLC

SEQ ID NO: 69 - protein, 713 aa, Oryza sativa
  MISC_FEATURE (1)..(713): Phenylalanine ammonia lyase
MACENGQVAADGINGLCMAAPRADPLNWGKAAEEMSGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLSAEATRAAMLVRINTLLQGYSGIRFEILEAITKLLNANVTPCLPLRGTVTASGDLVPLSYIAGLVTGRENSVAVAPDGSKVNAAEAFKIAGIQGGFFELQPKEGLAMVNGTAVGSGLASTVLFEANILAVLAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVSRDKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAVEILKLMSSTFLVALCQAIDLRQIEENVKSAVKSCVMTVARKTLSTSATGGLHAARFCEKDLLQEIDREAVFAYADDPCSANYPLMKKLRNVLVERALANGAAEFNAETSVFAKVAQFEEELRAALPAAVLAARAAVENGTAATPNRITECRSYPLYRFVREELGTAYLTGEKTRSPGEELNKVLVAINQGKHIDPLLECLKEWNGAPLPIC

SEQ ID NO: 70 - protein, 716 aa, Zea mays
  MISC_FEATURE (1)..(716): Phenylalanine ammonia lyase
MECDNGRVAATNGDSLCMALPRAADPLNWGKAAEEMMGSHLDEVKRMVAEYRQPLVKIEGASLRIAQVAAVAAGAGEARVELDESARGRVKASSDWVRDSMMNGTDSYGVTTGFGATSHRRTKEGGALQRELIRFLNAGAFGIGTDAGHVLPAEATRAAMLVRINTLLQGYSGIRFEILEAIVKLLNANVTPCLPLRGTVTASGDLVPLSYIAGLVTGRENAVAVAPDGTKVNAAEAFRIADIQSGFFELQPKEGLAMVNGTAVGSGLASTVLFEANVLAVLAEVLSAVFCEVMNGKPEYTDHLTHKLKHHPGQIEAAAIMEHILEGSSYMKLAKKLGELDPLMKPKQDRYALRTSPQWLGPQIEVIRASTKSIEREINSVNDNPLIDVARSKALHGGNFQGTPIGVSMDNTRLAVAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKKTLSTNSTGGLHVARFCEKDLLQEIEREAVFAYADDPCSANYPLMKKLRNVLVERALANGTAEFDAETSVFAKVAQFEEELRTALPSAVEAARAAVENGTAAIPNRIAECRSYPLYRFVREELGAVYLTGEKTRSPGEELNKVLVAINQGKHIDPLLECLKEWNGEPLPIC

SEQ ID NO: 71 - protein, 650 aa, Triticum urartu
  MISC_FEATURE (1)..(650): Phenylalanine ammonia lyase
MAKVAAVAAGSDTRVELDESARGRVKESSDWVMNSMMNGTDSYGVTTGFGATSHRRTKEGGALQRELIRFLNAGAFGTGTDGHVLPAAATRAAMLVRVNTLLQGYSGIRFEILETIATLLNANVTPCLPLRGTITASGDLVPLSYIAGLVTGRPNSMATAPDGSKVNAAEAFKIAGIQHGFFELQPKEGLAMVNGTAVGSGLASMVLFEANVLSLLAEVLSAVFCEVMNGKPEFTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDNNGHLHNARFCEKDLLLTIDREAVFAYADDPCSANYPLMQKMRAVLVEHALANGEAERDVETSVFAKLAMFEQELRAVLPKEVEAARSAVENGTAAQQNRIAECRSYPLYRFVRKELGTEYLTGEKTRSPGEEVDKVFVAMNQGKHIDALLECLKEWNGEPLPLC

SEQ ID NO: 72 - protein, 720 aa, Cenchrus purpureus
  MISC_FEATURE (1)..(720): Phenylalanine ammonia lyase
MECETGLVGSLHGDGLCMSAQAAAPRAADPLNWGKAAEDLSGSRLGEVKRMVAEFREPLVKIQGASLSIAQVAAVAAGAGGEARVELDESARERVKASSDWVMSSMMNGTDSYGVTTGFGATSHRRTKEGGALQRELIRFLNAGAFGTGADGHVLPAEATRAAMLVRINTLLQGYSGIRFEILEAIAKLLNANVTPCLPLRGTITASGDLVPLSYIAGLITGRQNSVAVAPGGRKVDAAEAFKIAGIEHGFFELQPKEGLAMVNGTAVGSGLASTVLFEANVLAIMAEAISAVFCEVMTGKPEFTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDYYNNGLPSNLSGGRNPSLDYGFKGAEIAMASYCSELQFLGNPVTNHVQSAEQHNQDVNSLGLISSRKTAEATDILKLMTSTFLIALCQAIDLRHLEENMKAAVKNCVTQVAKKTLFMNAMGGLHIARFCEKDLQTAIDREAVFAYADDPCSPNYPLMQKLRSVLIEHALANGDAERVVETSIFAKVAEFEQQVRAALPKEVEAARAAVESGNPMVPNRIKECRSYPLYRFVREEVGTEYLTGEKTRSPGEELNKVLVGINERKHIDPLLECLKEWNGEPLPLC

SEQ ID NO: 73 - protein, 712 aa, Hordeum vulgare
  MISC_FEATURE (1)..(712): Phenylalanine ammonia lyase
MECENGEAAANGNILCMAIQHADPLNWGKAAEELTGSHLDEVKRMVAEYRKPVVTIEGASLSIAKVAAVAAAGEVVVELDESARERVKASSDWVMNSMMNGTDSYGVTTGFGATSHRRTKEGGALQRELIRFLNAGAFGTGSDAHVLPAATTRAAMLVRINTLLQGYSGIRFEILEAVAKLLNANVTPCLPLRGTITASGDLVPLSYIAGLITGRDNSVAIGPDGTKVNAAEAFKIAGIHGGFFELQPKEGLAMVNGTAVGSALASTVLFEANILALLAEVISAVFCEVMNGKPEFTDHLTHKLKHHPGQIEAAAIMEHILEGSSYMKLAKKLGDLDPLMKPKQDRYALRTSPQWLGPQIEVIRAATKSIEREINSVNDNPLIDVSRGKAIHGGNFQGTPIGVSMDNTRLAIAAIGKLMFAQFSELVNDLYNNGLPSNLSGGRNPSLDYGFKGAEIAMASYCSELQFLGNPVTNHVQSAEQHNQDVNSLGLISSRKTAEAIEILKLMSSTFLVALCQAIDLRHIEENVKSAVKSCVMTVAKKTLSTNSTGGLHVARFCEKDLLQEIEREAVFAYADDPCSPNYPLMKKLRGVLVERALSNGMAEFDAETSVLAKVALFEEELRKTLPRAVEAARAAVESGTAEMPNRITECRSYPLYRFVREELGTVYLTGEKTRSPGEELNKVLVAINQGKHIDALLECLKEWNGEPLPIC

SEQ ID NO: 74 - protein, 715 aa, Hordeum vulgare
  MISC_FEATURE (1)..(715): Phenylalanine ammonia lyase
MECETGLVGSLNGDGLCVSAPRAADPLNWVKTAEELTGSHLDEVKKMVAQFREPLVTIEGASLGIAQVAAVAAGAGVARVALDESARGRVKESSDWVMTSMMNGTDSYGVTTGFGATSHRRTKEGGALQRELIRFLNAGAFGTGTDGHVLPAEATRAAMLVRINTLLQGYSGIRFEILEAITKLLNANVTPCLPLRGTITASGDLVPLSYIAGLITGRQNSVAVAPDGSKVTAAEAFKIAGIEHGFFELQPKEGLAMVNGTAVGSGLASTVLFEANVLSVLAEVLSAVFCEVMNGKPEFTDHLTHKLKHHPGQIEAAAIMEHILEGSSYMKQAKKLGELDPLMKPKQDRYALRTSPQWLGPQIEVIRFATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKIMSSTFLVALCQAIDLRHIEENMKTAVRNCVMQVAKKTLSMNNMGGLHIARFCEKDLLTAIDREAVFAYADDPCSPNYPLMQKLRAVLVEHALANGDGERALETSIFAKVAEFEQNIRAALPKEVEAARASVENGTPLAPNRIKDCRSYPLYQFVREVCGTEYLTGEKTRSPGEELNKVLVAMNERKHIDPLLECLKEWNGAPLPLC

SEQ ID NO: 75 - protein, 671 aa, Triticum urartu
  MISC_FEATURE (1)..(671): Phenylalanine ammonia lyase
MECENAHVAANGDGLGVGPPAGARVPAVPAGSDTRVELDESARGRVKESSDWVMNSMMNGTDSYGVTTGFGATSHRRTKEGGALQRELIRFLNAGAFGTGTDGHVLPAAATRAAMLVRVNTLLQGYSGIRFEILETVATLLNANVTPCLPLRGTITASGDLVPLSYIAGLVTGRPNSMATAPDGTKVNAAEAFKIAGIQHGFFELQPKEGLAMVNGTAVGSGLASMVLFEANILSLLAEVLSAVFCEVMNGKPKYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDTNGHLHNARFCEKDLLLTIDREAVFAYADDPCSANYPLMQKMRAVLVEHALANGEAERDVETSVFAKLATFEQELRAVLPKEVEAARSAVENGTAAQQNRIAECRSYPLCRFVRKELGTEYLTGEKMRSPGEEVDKVFVAMNQGKHIDALLECLKEWNGEPLPLC

SEQ ID NO: 76 - protein, 714 aa, Aegilops tauschii
  MISC_FEATURE (1)..(714): Phenylalanine ammonia lyase
MECETGLVGSLNGEGLCMSAPRADPLNWVKTAEELTGSHLQEVKKMVAQFREPLVTIEGASLGIAQVAAVAAGAGVARVALDESARGRVKESSDWVMTSMLCGADRCGVTAGFGATSHRRTKEGGALQRELIRFLNAGAFGTGTDGHVLPAEATRAAMLVRINTLLQGYSGIRFEILEAITKLLNANVTPCLPLRGTITASGDLVPLSYIAGLITGRQNSVAVAPDGSKVTAAEAFKIAGIEHGFFELQPKEGLAMVNGTAVGSGLASTVLFEANVLSVLAEVLSAVFCEVMNGKPEFTDHLTHKLKHHPGQIEAAAIMEHILEGSSYMKQAKKLGELDPLMKPKQDRYALRTSPQWLGPQIEVIRFATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKIMSSTFLVALCQAIDLRHIEENMKTAVRNCVMQVAKKTLSMNNMGGLHIARFCEKDLLTAIDREAVFAYADDPCSPNYPLMQKLRAVLVEHALANGDGERALETSIFAKVAEFEQNIRAALPKEVEAARASVENGTPLAPNRIKDCRSYPLYQFVREVCGTEYLTGEKTRSPGEELNKVLVAMNERKHIDPLLECLKEWNGEPLPLC

SEQ ID NO: 77 - protein, 711 aa, Brachypodium distachyon
  MISC_FEATURE (1)..(711): Phenylalanine ammonia lyase
MARENARVAAANGICTAIQHADPLNWGKAAEELTGSHLDEVKRMVVEYREPVVTIEGASLSIAKVAAVAAAGEAKVELDESARERVKASSDWVMNSMANGVDSYGVTTGFGATSHRRTKEGGALQRELIRFLNAGAFGTGSDGHVLPAGATRAAMLVRINTLLQGYSGIRFEILEAIAKLLNANVTPCLPLRGTITASGDLVPLSYIAGLVTGRENSVAVAPDGRKVNAAEAFKIAGIHGGFFELQPKEGLAMVNGTAVGSGLASTVLFEANILAVLAEVISAVFCEVMNGKPEFTDHLTHKLKHHPGQIEAAAIMEHILEGSSYMKLAKKQGELDPLMKPKQDRYALRTSPQWLGPQIEVIRAATKSIEREINSVNDNPLIDVSRGKAIHGGNFQGTPIGVSMDNTRLALAAIGKLMFAQFSELVNDLYNNGLPSNLSGGRNPSLDYGLKGAEIAMASYCSELQFLGNPVTNHVQSAEQHNQDVNSLGLISSRKTAEAIEILKLMSSTFLVALCQAIDLRHIEENVKSAVKSCVMTVAKKTLSTNSTGDLHVSRFCEKDMLQEIDREAVFAYADDPCNHNYPLMKKLRGVLVESALANGVAEYNVETSVFAKVAQFEEELRAALPKAVEAARAAVESGTAATPNRITECRSYPLYRFVREELGTVFLTGEKTRSPGEELNKVLMAINQGKHIDPLLECLKEWNGEPLPIC

SEQ ID NO: 78 - protein, 710 aa, Brachypodium distachyon
  MISC_FEATURE (1)..(710): Phenylalanine ammonia lyase
MACENGQVAANGICTAIQHADPLNWGKAAEALTGSHLEEVKRMVAEYRQPVVTIEGASLSIAKVAAVAAAGEAQVQLDESARERVKASSDWVMDSMANGVDSYGVTTGFGATSHRRTKEGGALQRELIRFLNAGAFGTGSDGHVLPAGATRAAMLVRINTLLQGYSGIRFEILEAIAKLLNANVTPCLPLRGTITASGDLVPLSYIAGLVTGRENSVAVAPDGSKVNAAEAFKIAGIHGGFFELQPKEGLAMVNGTAVGSGLASTVLFDANVLAVMAEVISAVFCEVMNGKPEFTDHLTHKLKHHPGQIEAAAIMEHILEGSSYMKLAKKLGDLDPLMKPKQDRYALRTSPQWLGPQIEVIRAATKSIEREINSVNDNPLIDVSRGKAIHGGNFQGTPIGVSMDNTRLALAAIGKLMFAQFSELVNDFYNNGLPSNLSGGRNPSLDYGFKGAEIAMASYCSELQFLGNPVTNHVQSAEQHNQDVNSLGLISARKTAEAIEILKLMTSTFLVALCQAIDLRHIEENVKSAVTSCVRAVAKKTLSTNSAGGLHVARFSEKDLIQEIDREAVFAYADDPCNPNYPLMKKLRGVLVERALANGVAEFDAETSVFAKVARFEEELRAALPVAVEAARAAVESGTAEAPNRIAECRSYPLYRFVRQELGTVYLTGEKTRSPGEELNKVLVAINQGKHIDPLLECLKEWNGEPLPIC

SEQ ID NO: 79 - protein, 657 aa, Aegilops tauschii
  MISC_FEATURE (1)..(657): Phenylalanine ammonia lyase
MGGASLPIAMVAAVAAGSDTRVELDESARGRVKESSDWVMNSMANGTDSYGVTTGFGATSHRRTKEGGALQRELIRFLNAGAFGTGGHNHVLPAATTRAAMLVRVNTLLQGYSGIRFEILETIAKLLNANVTPCLPLRGTITASGDLVPLSYIAGLVTGRANSVATAPDGSKVNAAGAFKIAGIEHGFFELQPKEGLAMVNGTAVGSGLASMVLFEANILGVLAEVLSAIFCEVMNGKPEYTDHLTHKLKHHPGQIEAAAIMEHILEGSSYMALAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGLKGAEIAMASYCSELQFLGNPVTNHVQSAEQHNQDVNSLGLISARKTAESIDILKLMSSTFLVALCQAIDLRHLEENVKDAVKSCVKTVARKTLSTNNNGHLHNARFCEKDLLLTIDREAVFTYADDPCSANYPLMQKMRAVLVEHALANGDAEHDVETSVFAKLAMFEQELRVVLPKEVEAARSAVENGTAAQQNRITECRSYPLYRFVRKELGTEYLTGEKTRSPGEEVDKVFIAMNQGKHIDALLECLKEWNGEPLPIC

SEQ ID NO: 80 - protein, 716 aa, Brachypodium distachyon
  MISC_FEATURE (1)..(716): Phenylalanine ammonia lyase
MTMASKNVHVSADGYLILCPATSQHADPLNWGKAAEALTGSHLEEVKRMVAEYRQPVVTIEGASLSIAKVAAVAAAGEAQVQLDESARERVKASSDWVMDSMANGVDSYGVTTGFGATSHRRTKEGGALQRELIRFLNAGAFGTGSDGHVLPAGATRAAMLVRINTLLQGYSGIRFEILEAIAKLLNANVTPCLPLRGTITASGDLVPLSYIAGLVTGRENSVAVAPDGSKVNAAEAFKIAGIHGGFFELQPKEGLAMVNGTAVGSGLASTVLFDANVLAVMAEVISAVFCEVMNGKPEFTDHLTHKLKHHPGQIEAAAIMEHILEGSSYMKLAKKLGDLDPLMKPKQDRYALRTSPQWLGPQIEVIRAATKSIEREINSVNDNPLIDVSRGKAIHGGNFQGTPIGVSMDNTRLALAAIGKLMFAQFSELVNDFYNNGLPSNLSGGRNPSLDYGFKGAEIAMASYCSELQFLGNPVTNHVQSAEQHNQDVNSLGLISARKTAEAIEILKLMTSTFLVALCQAIDLRHIEENVKSAVTSCVRAVAKKTLSTNSAGGLHVARFSEKDLIQEIDREAVFAYADDPCNPNYPLMKKLRGVLVERALANGVAEFDAETSVFAKVARFEEELRAALPVAVEAARAAVESGTAEAPNRIAECRSYPLYRFVRQELGTVYLTGEKTRSPGEELNKVLVAINQGKHIDPLLECLKEWNGEPLPIC

SEQ ID NO: 81 - protein, 709 aa, Musa acuminata
  MISC_FEATURE (1)..(709): Phenylalanine ammonia lyase
MEFERNGHHANGGLCIKDPLNWAAAAEALTGSHLDEVKKMVAESRQPLVSLEGTTLKIAHVAAVAGQSGARVELSESARGRVRASSDWVMDSMTKGTDSYGVTTGFGATSHRRTKQGGALQKELIRFLNAGIFGSGSDQSGHTLPPPATRAAMLVRINTLLQGYSGIRFEILEAITSLLNSNITPCLPLRGTITASGDLVPLSYIAGILTGRPNSKAISPAGEAIDAAEAFRLAGIPHGFFELQPKEGLALVNGTAVGSGLASMVLFDANILAVLSEVLSAIFCEVMQGKPEFTDHLTHKLKHHPGQIEAAAIMEHVLEGSSYMKMAKKLHEQDPLQKPKQDRYALRTSPQWLGPQIEVIRSSTKSIEREINSVNDNPLIDVSRNKALHGGNFQGTPIGVSMDNTRLAIAAIGKLMFAQFSELVNDFYNNGLPSNLSGGRNPSLDYGFKGAEIAMAAYCSELQFLANPVTNHVQSAEQHNQDVNSLGLISSRKTAEAVDILKLMSSTYLVALCQAIDLRHLEENLKNAVKNTVIQVAKKTLTTGVNGELHPSRFCEKDLITIIDREHVFSYVDDPCSSTYPLMQKLRQVLVEHALNNGEKEKDPNTSIFQKITAFEEELKAALPKEVEAARAAVENGNAATANRIEECRSYPLYRFVRAELSTGYLTGEKVRSPGEDFDKIFAAINKGMVIDPLLECLKEWNGAPLPIC

SEQ ID NO: 82 - protein, 705 aa, Aegilops tauschii
  MISC_FEATURE (1)..(705): Phenylalanine ammonia lyase
MWWTLNWGKAAEELTGSHLDEVKRMVADYRKPVVTIEGASLSIAKVAAVAAAGAGGVGLDEAGPAGEVVVELDESARARVKASSDWVMNSMMNGTDSYGVTTGFGATSHRRTKQGGALQRELIRFLNAGAFGTGSDAHVLPAATTRAAMLVRINTLLQGYSGIRFEILEAVAKLLNANVMPCLPLRGTITASGDLVPLSYIAGLITGRENSVAIGPDGTKVNAAEAFKIAGIHGGFFELQPKEGLAMVNGTAVGSALASTVLFEANILALLAEVISAVFCEVMNGKPEFTDHHTHKLKHHPGQIEAAAIMEHILEGSSYMKLAKKLGDLDPLMKPKQDRYALRTSPQWLGPQIEVIRAATKSIEREINSVNDNPLIDVSRGKAIHGGNFQGTPIGVSMDNTRLAIAAIGKLMFAQFSELVNDLYNNGLPSNLSGGHNPSLDYGFKGAEIAMASYCSELQFLGNPVTNHVQSSEQHNQDVNSLGLISFRKTAEAIEILKLMSSTFLVALCQAIDLRHIEENVKSAVKSCVLTVAKKTLSTNSTSGLHVARFCEKDLLQEIEREAVFAYADDPCSPNYPLMKKLRGVLVERALSNGMAEFDAETSVFAKVALFEEELRKTLPPAIEAARAAVESGTAEMPNRITECCSYPLYRFVREELGTVYLTGEKTLSPGEELNKVFVAMNQGKHIDALLECLKEWNGEPLPIC

SEQ ID NO: 83 - protein, 808 aa, Triticum urartu
  MISC_FEATURE (1)..(808): Phenylalanine ammonia lyase
MECENGHVAANGDGLVAAVAAGSDTRVELDESARGRVKESSDWVMNSMMNGTDSYGVTTGFGATSHRRTKEGGALQRELIRFLNAGAFGNGNDGHVLPAAATRAAMLVRVNTLLQGYSGIRFEILETIATLLNANVTPCLPLRGTITASGDLVPLSYIAGLVTGRPNSMATAPDGTKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTNNNGHLHNARFCEKDLLLTIDREAVFAYADDPCSANYPLMQKMRAVLVEHALANGEAERDVETSVFAKLAIFEQELRAVLPKEVEAARSAVENGTATQQNRIAECRSYPLYRFVRKELGTVYLTGEKTRSPGEEVDKVFVAMNQGKHIDALLECLKGWNELPDCCQKLQLHALINGLVVLETTSNSANNLLCFLNCKESIVGLLYETCNSKGNKLYVREKGHSVRISDKHVRIGKRDLFRRRMLEDKKCCPVSKSEKNFNLFSRCFKIIGLAYTITLILDNHIVQKYRTCLSRHKVFDSHIIGAPRTIPQRA

SEQ ID NO: 84 - protein, 710 aa, Oryza sativa
  MISC_FEATURE (1)..(710): Phenylalanine ammonia lyase
MECENGRVSANGMSGLCVRPRADPLNWGKATEEMTGSQVDEVKRIGAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIAKLLNANVTPCLPLRGTITASGDLVPLSYIAGLVTGRENAWALPPDGSKVNAAEGLKIAGIQGGFFELQPKEGLAMVNGTAVGSGLASTVLFEANILAILAEVLSAVFCEVMNGKPEYTDHLTHKLKHHPGQIEAAAIMKHILEGSSYMKHAKKLGELDPLMKPKQDRYALRTSPQWLGPQIEVIRAATKSIEREINSVNDNPLIDVSRGKALHGGNFQGTPIGLSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLIALCQAVDLRHIEENVKSAVKSCVMTVAKKTLSTNSTGDLHVARFCEKDLLKEIDREGVFAYGDDPCSHNYPLMKKLRNVLVERALANAGRVQRRHLGVRQGRAVRGGLRATLPGAIDGRAAVENGTAAIPSRITECRSYPLYRFVREELGTKYLTGEKTRSPGEELNKVLVAINEGKHIDPLLECLKEWNGEPLPIC

SEQ ID NO: 85 - protein, 726 aa, Aegilops tauschii
  MISC_FEATURE (1)..(726): Phenylalanine ammonia lyase
MECENGHVAANLCVAQPARADPLNWGKAAEELSGSHLDAVKRMVEEYRRPVVTMEGASLTVAMVAAVAAGAVTRVELDDSARGRVKESSDWVMNSMTNGTDSYYGDATSHRTTKEVSALQRELVRYKLTQEKRIILHFFIVSVYALMRAGAFGTGKDGHVLPAAATRAVMLVRVNTLLQGYSGVRFQILETIVTLLNTNVTPCQPLRGTLTASGDLVPLSYIAGLVTGRPNCMATTPDGTKVNAAEAFNIAGIQHGFFELQPKEGLAMMNSTAVGSGLASMVLFEANILGLLAEVLSAVFCEVMNGNPEYTDHLTHKLKHHPGQIEAAAIMEHILEGSSYMMLKKKLDELDTPMKPKQDRYALCTSPQWLGPQIEDIRSATKSIEREINSVNNNPLIDVSRGKAIHGGNFQGTPIGVSMDNTGLSIAAIGKLMFAQFSELVNDFYNNGLPSNLSGGRNLSLDYGFKGAEIVMASYCSELQFLGNPVTNHVQSAEQHNQGVNSLGLISSRKTAEAIEILKLMSSTFLVALCQAIDLRHLEENVKNVVKNCVKMVARKTLVTNNNGHLHNARFCEEDLLLTVDREAVFAYADDPCSSNYPLMQKMRAVLVENALANGEAERDVETSVFAKLAMSEQELRALLPKEVEAARSAVENGTAAQQNRIIECRSYPLYRFVRKELGTEYLAGEKTRSPGEEVDKVFVAMNKGKHIDALLECLKEWTGEPLPIR

SEQ ID NO: 86 - protein, 712 aa, Musa acuminata
  MISC_FEATURE (1)..(712): Phenylalanine ammonia lyase
MEFAPKAQVVENGEAFCLKADPLNWIKAAESLTGSHLDEVKRMVEEFRKPLVRLEGATLTISQVAAVAAARSPVRVELSEEARDGVRASSEWVMESMNKGTDSYGVTTGFGATSHRRTKQGGALQKELIRFLNAGIFGSGTESAHTLPTPAARAAMLVRVNTLLQGYSGIRFEILEAMASLLNSGITPCLPLRGTITASGDLVPLSYIAGVLTGRPNAKAVRPGGEAVDAAEAFRRSGIPHGFFELQPKEGLALVNGTAVGSGLASVVLYEANVLAVLAEVLSAVFCEVMQGKPEFTDHLTHKLKHPPGQIEAAAIMEHVLEGSSYMKMAKKLHEQDPLQKPKQDRYALRTSPQWLGPQIEVIRSSTKSIEREINSVNDNPLIDVSRNKALHGGNFQGTPIGVSMDNTRLAIAAIGKLMFAQFSELVNDFYNNGLPSNLSGGRNPSLDYGFKGAEIAMAAYCSELQFLANPVTNHVQSAEQHNQDVNSLGLISSRKTAEAVDILKLMSTTYLVALCQAIDLRHLEENLKNAVKNTVIQVAKKTLTTGVNGELHPSRFCEKDLITIIDREHVFSYVDDPCSSTYPLMQKLRQVLVEHALNNGEKEKDPNTSIFQKITAFEEELKAALPKEVEAARAAVENGNAATANRIEECRSYPLYRFVRAELSTGYLTGEKVRSPGEDFDKIFAAINKGMVIDPLLECLKEWNGAPLPIC

SEQ ID NO: 87 - protein, 712 aa, Musa acuminata
  MISC_FEATURE (1)..(712): Phenylalanine ammonia lyase
MEFAPKAQVVENGEAFCLKADPLNWIKAAESLTGSHLDEVKRMVEEFRKPLVRLEGATLTISQVAAVAAARSPVRVELSEEARDGVRASSEWVMESMNKGTDSYGVTTGFGATSHRRTKQGGALQKELIRFLNAGIFGSGTESAHTLPTPAARAAMLVRVNTLLQGYSGIRFEILEAMASLLNSGITPCLPLRGTITASGDLVPLSYIAGVLTGRSNAKAVRPGGEAVDAAEAFRRSGIPHGFFELQPKEGLALVNGTAVGSGLASVVLYEANVLAVLAEVLSAVFCEVMQGKPEFTDHLTHKLKHHPGQIEAAAIMEHVLEGSSYMKMAKKLHEQDPLQKPKQDRYALRTSPQWLGPQIEVIRSSTKSIEREINSVNDNPLIDVSRNKALHGGNFQGTPIGVSMDNTRLAIAAIGKLMFAQFSELVNDFYNNGLPSNLSGGRNPSLDYGFKGAEIAMAAYCSELQFLANPVTNHVQSAEQHNQDVNSLGLISSRKTAEAVDILKLMSTTYLVALCQAIDLRHLEENLKNAVKNTVIQVAKKTLTTGVNGELHPSRFCEKDLITIIDREHVFSYVDDPCSSTYPLMQKLRQVLVEHALNNGEKEKDPNTSIFQKITAFEEELKAALPKEVEAARAAVENGNAATANRIEECRSYPLYRFVRAELCTGYLTGEKVRSPGEDFDKIFAAINKGMVIDPLLECLKEWNGAPLPIC

SEQ ID NO: 88 - protein, 615 aa, Aegilops tauschii
  MISC_FEATURE (1)..(615): Phenylalanine ammonia lyase
MMNGTDSYGVTTGFGATSHRRTKEGGALQRELIRFLNAGAFGTGTDGHVLPAAATRAAMLVRVNTLLQGYSGIRFEILETVATLLNANVTPCLPLRGTITASGDLVPLSYIAGLVTGRPNSMATAPDGTKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDTNGNLHNARFCEKDLLLTIDREAVFAYADDPCSANYPLMQKMRAVLVEHALANGEAERDVETSVFAKLATFEQELRAVLPKEVEAARSAVENGTAAQQNRIAKCRSYPLYRFVRKELGTEYLTGEKTRSPGEEVDKVFIAMNQGKHIDALLECLKEWNGEPLPIC

SEQ ID NO: 89 - protein, 723 aa, Oryza sativa
  MISC_FEATURE (1)..(723): Phenylalanine ammonia lyase
MECETGLVRSLNGDGLCMSSVSAPPRADPLNWGKAADELAGSHLDEVKRMVEDFRQPLVKIEGASLTIAQVAAVAAGAGDARVELDESARGRVKASSDWVMNSMMNGTDSYGVTTGFGATSHRRTKEGGALQRELISRHGGNSSMPAPSAPAPTATFCRRRRRARRCSSASTPSSRGYSGIRFEILEAITKLLNANVTPCLPLRGTITASGDLVPLSYIAGLITGRQNSVAVAPDGRKVTAAEAFKIAGIEHGFFELQPKEGLAMVNGTAVGSGLASTVLFEANVLAILAEVLSAVFCEVMTGKPEYTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLIALCQAIDLRHLEENMKTAVKNCVMQVAKKSLSMNHMGGLHIARFCEKDLLTAIDREAVFAYADDPCSANYPLMQKLRAVLIEHALANGDAERVLETSIFAKVAEFEQHVRAALPKEVEAARAAVENGTPLVPNRIKECRSYPLYRFVREEVGTEYLTGEKTRSPGEELNKVLVAINERKHIDPLLECLKEWNGAPLPLC

SEQ ID NO: 90 - protein, 618 aa, Hordeum vulgare
  MISC_FEATURE (1)..(618): Phenylalanine ammonia lyase
MNSMMNGTDSYGVTTGFGATSHRRTKEGGALQRELIRFLNAGAFGTGNDGHVLPAAATRAAMLVRVNTLLQGYSGIRFEILETVATLLNANVTPCLPLRGTITASGDLVPLSYIAGLVTGRPNSMATAPDGTKVNAAEAFKIAGIQHGFFELQPKEGLAMVNGTAVGSGLASMVLFEANILSLLAEVLSAVFCEVMNGKPEYTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDLYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTNSNGHLHSARFCEKDLLLTIDREAVFAYADDPCSANYPLMQKMRAVLVEHALANGEAERDVETSVFAKLAMFEQELRAMLPKEVEAARSAVENGTATQQNRITECRSYPLYRFVRKELGTEYLTGEKTRSPGEEVDKVFVAMNKGKHIDALLECLKGWNGEPLPIC

SEQ ID NO: 91 - protein, 712 aa, Musa balbisiana
  MISC_FEATURE (1)..(712): Phenylalanine ammonia lyase
MEFAPKAQVVENGEAFCLKADPLNWIKAAESLTGSHLDEVKRMVEEFRKPLVRLEGATLTISQVAAVAAARSPVRVELSEEARDGVRASSEWVMESMNKGTDSYGVTTGFGATSHRRTKQGGALQKELIRFLNAGIFGSGPESGNTLPSSAAKAAMLVRVNTLLQGYSGIRFEILEAIASLLNNGITPCLPLRGTITASGDLVPLSYIAGILTGRPNAKAVGPDGKVIGAAEAFRLASIADGFFELQPKEGLALVNGTAVGSGLASMVLFEANVLAVLSEVLSAVFCEVMQGKPEFTDHLTHKLKHHPGQIEAAAIMEHILEGSSYMKMAKKLHEQDPLQKPKQDRYALRTSPQWLGPQIEVIRASTKSIEREINSVNDNPLIDVSRSKALHGGNFQGTPIGVSMDNTRLAVAAIGKLMFAQFSELVNDFYNNGLPSNLSGGRNPSLDYGFKGAEIAMAAYCSELQFLANPVTNHVQSAEQHNQDVNSLGLISARKTAEAVDILKLMSTTYLVALCQAVDLRHLEENLKSAVKSTVSQVAKRVLTMGANGELHPARFCEKELIKVVDREHVFTYVDDPCSATYPLMQKLRQVLVAHALENGDKEKDAGSSIFQKIATFEEELTAQLPKEVEAARAAVEGGKAAIPNRIEECRSYPLYRLVREELKTGFLTGEKVRSPGEEFDKVFDAICQGKVIDPLLECLKEWNGAPLPIC

SEQ ID NO: 92 - protein, 716 aa, Sparganium stoloniferum
  MISC_FEATURE (1)..(716): Phenylalanine ammonia lyase
MECEPATAHVNGTANGSAAGFCLKDPLNWAKAAEALSGSHLDEVKRMVEDYRAPVVLLEGASLNISQVAAVAAAESEVTVELSEAKREGVKASSDWVMESMMKGTDSYGVTTGFGATSHRRTKQGGALQKELIRFLNAGVFGSGPEPGHTLPPAATRAAMLVRINTLLQGYSGIRLEILEAITSLLNSNVTPCLPLRGTITASGDLVPLSYIAGLLTGRPNSIAKTSDGRSVDAGEAFRLAGITHGFFELQPKEGLALVNGTAVGSGLASMVLFETNILAVLAEVLSAIFAEVMQGKPEFTDHLTHKLKHHPGQIEAAAIMEHILEGSSYVKMAKKLHEVDALQKPKQDRYALRTSPQWLGPQIEVIRASTKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTYLIALCQAIDLRHLEENLKSSVKNTVTQVAKKVLTMGVNGELHPSRFCEKDLIKIIDHEYVFSYVDDPCSSTYPLMQKLRQVLVEHALNNGEKEKDANTSIFQKIADFEEELKTQLPKEVEATRLAFENGTSTIGNRIKDCRSYPIYRFVREELGTSFLTGEEVRSPGEEFDKVFNASNRGKVIDPLLECLKEWNGAPLPIC

SEQ ID NO: 93 - protein, 709 aa, Ornithogalum longebracteatum
  MISC_FEATURE (1)..(709): Phenylalanine ammonia lyase
MESLHANGNGLCVPIDDPLNWGAAAESLRGSHLDEVKKMVKEFRGPLVRLEGATLKVAQVAAVAAAGESPVTVELAESARAGVKASSDWVMDSMSKGTDSYGVTTGFGATSHRRTKQGGALQKELIRFLNAGIFGSGPESGCTLPATATRAAMLVRINTLLQGYSGIRFEILEAITSLLNGKITPCLPLRGTITASGDLVPLSYIAGILTGRPNSKAVAPDGRTVSAAEAFELAGIESGFFELQPKEGLALVNGTAVGSGVASMVLYEANILAVLAEVMSAVFCEVMQGKPEYTDHLTHKLKHHPGQIEAAAIMEHVLEGSSYMKMAKKLHELDPLQKPKQDRYALRTSPQWLGPQIEVIRSATKSIEREINSVNDNPLIDVSRNKALHGGNFQGTPIGVSMDNTRLAIAAIGKLMFAQYSELVNDFYNNGLPSNLSGGRNPSLDYGFKGAEIAMASYCSELQFLGNPVTNHVQSAEQHNQDVNSLGLISARKTAEAVEILKLMSSTFLVGLCQAIDLRHLEENLRSTVKNTVGQVAKRVLTVGANGELHPSRFCEKDLIKVIDREYVFAYIDDPCSATYPLMQKLRQVLVEHALGNGDKEKDHNTAIFHKIAVFEEELKAALPKEVEAARVAFESGSSAIPNRIKECRSYPLYRLVRDELGTGYLTGEKVRSPGEEFNKVFDALCKGKLIDPLLECLSEWNGAPLPIC

SEQ ID NO: 94 - protein, 615 aa, Aegilops tauschii
  MISC_FEATURE (1)..(615): Phenylalanine ammonia lyase
MMNGTDSYGVTTGFGATSHRRTKEGGALQRELIRFLNAGAFGTGTDGHVLPAAATRAAMLVRVNTLLQGYSGIRFEILETIATLLNANVTPCLPLRGTITASGDLVPLSYIAGLVTGRPNSMATAPDGSKVNAAEAFKIAGIQHGFFELQPKEGLAMVNGTAVGSGLASMVLFEANVLSLLAEVLSAVFCEVMNGKPEFTDHLTHKLKHHPGQIEAAAIMEHILEGSSYMMLAKKLGELDPLMKPKQDRYALRTSPQWLGPQIEVIRAATKSIEREINSVNDNPLIDVSRGKAIHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTAEAIDILKLMSSTFLVALCQAIDLRHLEENVKNAVKSCVKTVARKTLSTDNNGHLHKARFCEKDLLLTIDREAVFVYADDPCSANYPLMQKMRAVLVEHALANGEAERDVETSVFAKLAMFEQELRAVLPNEVEAARSAVENGTATQQNRIADCRSYPLYRFVRKELGTEYLTGEKTRSPGEEVDKVFVAMNQGKHIDALLECLKEWNGEPLPIC

SEQ ID NO: 95 - protein, 712 aa, Musa acuminata
  MISC_FEATURE (1)..(712): Phenylalanine ammonia lyase
MEFAPKAQVVENGEAFCLKADPLNWIKAAESLTGSHLDEVKRMVEEFRKPQVRLEGATLTISQVAAVAAARSPVRVELSEEARDGVRASSEWVMESMNKGTDSYGVTTGFGATSHRRTKQGGALQKELIRFLNAGIFGSGPESGNTLPSSAAKAAMLVRVNTLLQGYSGIRFEILEAIASLLNNGITPCLPLRGTITASGDLVPLSYIAGILTGRPNAKAVGPDGKVIGAAEAFRLAGIADGFFELQPKEGLALVNGTAVGSGLASMVLFEANVLAVLSEVLSAVFCEVMQGKPEFTDHLTHKLKHHPGQIEAAAIMEHILEGSSYMKMAQKLHEQDPLQKPKQDRYALRTSPQWLGPQIEVIRASTKSIEREINSVNDNPLIDVSRSKALHGGNFQGTPIGVSMDNTRLAVAAIGKLMFAQFSELVNDFYNNGLPSNLSGGRNPSLDYGFKGAEIAMAAYCSELQFLANPVTNHVQSAEQHNQDVNSLGLISARKTAEAVDILKLMSTTYLVALCQAVDLRHLEENLKSAVKSTVSQVAKRVLTMGANGELHPARFCEKELIKVVDREHVFTYVDDPCSATYPLMQKLRQVLVAHALENGDKEKDAGSSIFQKIATFEEELKAQLPKEVEAARSAVEGGKAAIPNRIEECRSYPLYRLVREELKTGFLTGEKVTSPGEEFDKVFDAICQGKVIDPLLECLKEWDGAPIPIC

SEQ ID NO: 96 - protein, 697 aa, Triticum urartu
  MISC_FEATURE (1)..(697): Phenylalanine ammonia lyase
MELIQELVNHRGKEEVGAARSGCAGGRAPSRLGLRAAARLRRLGAVDSWCSTQLAAAGEVVVELDESARERVKASSDWVMNSMMNGTDSYGVTTGFGATSHRRTKEGGALQRELIRFLNAGAFGTGSDAHVLPAATTRAAMLVRINTLLQGYSGIRFEILEAVAKLLNANVTPCLPLRGTITASGDLVPLSYIAGLVTGRENSVAIGPDGKKVNAAEAFKIAGIHGGFFELQPKEGLAMVNGTAVGSALASTVLFEANILALLAEVISAVFCEVMNGKPEFTDHLTHKLKHHPGQIEAAAIMEHILEESSYMKLAKKLGDLDPLMKPKQDRYALRTSPQWLGPQIEVIRAATKSIEREINSVNDNPLIDVSRGKAIHGGNFQGTPIGVSMDNTRLAIAAIGKLMFAQFSELVNDLYNNGLPSNLSGGRNPSLDYGFKGAEIAMASYCSELQFLGNPVTNHVQSAEQHNQDVNSLGLISSRKTAEAIEILKLMSSTFLVALCQAIDLRHIEENVKSAIKSCVSTVAKKTLSTNSTGGLHVARFCGKDLLQEIEREAVFAYADDPCSPNYPLMKKLRGVLVERALSNGMAEFDAETSVFAKVALFEEELRKTLPPAVEAARVAVESGTAEMPNRITECRSYPLYRFVREELGTVYLTGEKTLSPGEELNKVLVAMNQGKHIDALLECLKEWNGEPLPIC

SEQ ID NO: 97 - protein, 711 aa, Musa acuminata
  MISC_FEATURE (1)..(711): Phenylalanine ammonia lyase
MEMENGGVHANGSLCIRTDPLNWGAAAEAVTGSHLEEVKRMVGEFRQPLVRLEGATLKISQVAAVATEPHSAVRVELSESAREGVRASSQWVMDSMTKGTDSYGVTTGFGATSHRRTKQGGALQQELIRFLNAGIFGSGAESGHTLPTPAARAAMLVRINTLLQGYSGIRFEILEAMASLLNSGITPCLPLRGTITASGDLVPLSYIAGLLTGRGNAKALAPGGEWVDAAEAFRRAGIPHGFFELQPKEGLAMVNGTAVGSGLASLVLYEVNVLAVLAEALSAVFCEVMQGKPEFTDHLTHKLKHHPGQIEAAAIMEHILDGSSYMKMAKKLHEQDPLQKPKQDRYALRTSPQWLGPQIEVIRASTKSIEREINSVNDNPLIDVSRNKALHGGNFQGTPIGVSMDNTRLAVAAIGKLMFAQFSELVNDFYNNGLPSNLSGGRNPSLDYGFKGAEIAMAAYCSELQFLANPVTNHVQSAEQHNQDVNSLGLISSRKTAEAVDILKLMSATYLVALCQAIDLRHLEENLKHAVKNTVGQVAKRVLTTGANGELHPSRFCEKDLIMVVDRENVFSYIDDPCSSTYALMPKLRMVLVEHALSNGEKEKDATTSVFQKITAFEEELKAVLPKEVEAARAAVEGGNAAIANRIRECRSYPLYRLVREELGVAYLTGEKARSPGEEFDKVFMAVNEGLLIDPLLECLKEWNGAPLPIC

SEQ ID NO: 98 - protein, 708 aa, Cinnamomum osmophloeum
  MISC_FEATURE (1)..(708): Phenylalanine ammonia lyase
METTQETGNVLQSFCLKDPLNWEMAAESLKGSHLEEVKRMVDEFRKPLIQLEGATLTISQVAAIARDSDVMVELADSARARVKASSDWVMDSMSKGTDSYGVTTGFGATSHRRTKQGGALQKELIRFLNAGVFGGAGESGHTLPPSATRAAMLVRINTLMQGYSGIRFEILEAITSLLNHSITPCLPLRGTITASGDLVPLSYIAGILTGRPNSKATAPDGRVIDAVEAFHLAGITDGFFELQPKEGLALVNGTAVGSGLASMVLFEANVLSVLSEVISAIFCEVMQGKPEYTDHLTHKLKHHPGQIEAAAIMEHILDGSSYMKVAKKLHDLDPLQKPKQDRYALRTSPQWLGPQIEVIRNSTRSIEREINSVNDNPLIDVSRNKALHGGNFQGTPIGVSMDNTRLAIAAIGKLMFAQFSELVNDFYNNGLPSNLSGGRNPSLDYGFKGAEIAMAAYCSELQFLANPVTNHVQSAEQHNQDVNSLGLISSRKTAEAVDILKLMSATYLVGLCQAIDLRHLEENLKSTVKNTVSQVAKRVLTIGVNGELHPSRFCEKDLIKVVDREYLFAYIDDPCSSTYPLMQKLRQVLVEHALNNEEKEKDLNTSIFQKIAAFEEELKTHLPKEVESARAEWESGNPAIANRIKECRSYPLYKFVREELKTSLLTGERVRSPGEEFDKVFAAICEGKVIDPFLECLREWNGAPLPIC

SEQ ID NO: 99 - protein, 717 aa, Prunus avium
  MISC_FEATURE (1)..(717): Phenylalanine ammonia lyase
MATNSIKQNGHKNGSVELPELCIKKDPLNWGVAAETLKGSHLDEVKRMVAEYRKPVVKLGGESLTISQVAAIATHDSGVKVELSESARAGVKASSDWVMDSMSKGTDSYGVTTGFGATSHRRTKQGAALQKELIRFLNAGVFGSTKESGHTLPHQATRAAMLVRINTLLQGYSGIRFEILEVITKFLNNNVTPCLPLRGTITASGDLVPLSYIAGMLTGRPNSKAVGPDGQTLSAAEAFEFVGINSGFFELQPKEGLALVNGTAVGSGLASTVLFDTNILALLSEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREIDSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLRNTVKNTVSQVAKRTLTTGVNGELHPSRFCEKDLLKVVDREYVFAYIDDPCSATYPLMQKLRQVLVEHALTNGENEKNASTSIFQKIVAFEEELKVLLPKEVDSARAALDSGSAGVPNRITECRSYPLYKFVREELGAEYLTGEKVRSPGEECDKVFTAICEGKIIDPILDCLEGWNGAPLPIC

SEQ ID NO: 100 - protein, 717 aa, Prunus salicina
  MISC_FEATURE (1)..(717): Phenylalanine ammonia lyase
MATNSIKQNGHQNGSLESSELCIKKDPLNWGVAAETLKGSHLDEVKRMVAEYRKPVVKLGGESLTISQVAAIATHDSGVKVELSESARAGVKASSDWVMDSMSKGTDSYGVTTGFGATSHRRTKQGAALQKELIRFLNAGVFGSTKESGHTLPHQATRAAMLVRINTLLQGYSGIRFEILEVITKFLNNNVTPCLPLRGTITASGDLVPLSYIAGMLTGRPNSKAVGPDGQTLSAAEAFEFVGINSGFFELQPKEGLALVNGTAVGSGLASTVLFDTNILALLSEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREINSVNDNPLIDVSRNKALHGGNFQGTPIGVSMDNTRLAIASIGKLMFAQFSELVNDFYNNGLPSNLSGGRNPSLDYGFKGAEIVMASYCSELQFLANPVTNHVQSAEQHNQDVNSLGLISSRKTAEAVDILKLMSSTFLVALCQAIDLRHLEENLRNTVKNTVSQVAKRTLTTGVNGELHPSRFCEKDLLKVVDREYVFAYIDDPCSATYPLMQKLRQVLVEHALTNGENEKNASTSIFQKIVAFEEELKVLLPKEVDSARAALDSGSAGVPNRITECRSYPLYKFVREELGAEYLTGEKVRSPGEECDKVFSAICEGKIIDPILECLEGWNGAPLPIC

SEQ ID NO: 101 - protein, 717 aa, Prunus mume
  MISC_FEATURE (1)..(717): Phenylalanine ammonia lyase
MATNSIKQNGHQNGSLESSELCIKKDPLNWGVAAETLKGSHLDEVKRMVAEYRKPVVKLGGESLTISQVAAIATHDSGVKVELSESAQAGVKASSDWVMDSMSKGTDSYGVTTGFGATSHRRTKQGAALQKELIRFLNAGVFGSTKESGHTLPHQATRAAMLVRINTLLQGYSGIRFEILEVITKFLNNNVTPCLPLRGTITASGDLVPLSYIAGMLTGRPNSKAVGPDGQTLSAAEAFEFVGINSGFFELQPKEGLALVNGTAVGSGLASTVLFDTNILALLSEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLRNTVKNTVSQVAKRTLTTGVNGELHPSRFCEKDLLKVVDREYVFAYIDDPCSATYPLMQKLRQVLVEHALTNGENEKNASTSIFQKIVAFEEELKVLLPKEVDSARAALDSGSAGVPNRITECRSYPLYKFVREELGAEYLTGEKVRSPGEECDKVFSAICEGKIIDPILDCLEGWNGAPLPIC

SEQ ID NO: 102 - protein, 711 aa, Ornithogalum longebracteatum
  MISC_FEATURE (1)..(711): Phenylalanine ammonia lyase
MENGNGNCNGNTGNIHAPLCLGNDPLNWGAAAEALTGSHLDEVKRMVEEFRRPLVRLEGADLKISQVAAVAAGGQTVAVELSESARAGVRASSEWVMDSMSKGTDSYGVTTGFGATSHRRTKEGGALQRELIRFLNAGIFGSGNTLPASATRAAMLVRINTLLQGYSGIRFEILEAITALLNHNITPCLPLRGTITASGDLVPLSYIAGLLTGRPNSKAVGPDGHEIDAAEAFKIAGIPSGFFDLQPKEGLALVNGTAVGSGLASTVLFEANILAVLAEIMSAIFCEVMQGKPEFTDHLTHKLKHHPGQIEAAAIMEHILEGSSYMQMAKKAHELDPLQKPKQDRYALRTSPQWLGPQIEVIRASTKSIEREINSVNDNPLIDVSRNKALHGGNFQGTPIGVSMDNTRLAIAAIGKLMFAQMSELVNDFYNNGLPSNLSGGRNPSLDYGFKGAEIAMAAYCSELQYLANPVTNHVQSAEQHNQDVNSLGLISSRKTAEAVEILKLMTSTFLIALCQAIDLRHLEENLKQAVKNTVSQVSKRVLTTGINGELHPSRFCEKDLIKVIDREYVFAYIDDPCSYTYPLMQKLRQVLVEYALNNGEKEKDANTSIFQKIAAFEEELEAALPKEVEAARAAVENGTALIANGIKECRSYPLYRFMREELGTELLTGEKVRSPGEEIDKVFVAISQGKMIDPMLECLRDWNGAPLPIC

SEQ ID NO: 103 - protein, 715 aa, Daucus carota
  MISC_FEATURE (1)..(715): Phenylalanine ammonia lyase
MECENGVIANGHANGNGVELCMKGDPLNWGVAAEAMTGSHLDEVKRMVAEYRKPVVKLGGETLTISQVAAISARDGSGVTVELSEAARAGVKASSDWVMDSMNKGTDSYGVTTGFGATSHRRTKQGGALQKELIRFLNAGIFGNGSDNTLPHSATRAAMLVRINTLLQGYSGIRFEILEAITKFLNQNITPCLPLRGTITASGDLVPLSYIAGLLTGRPNSKAVGPTGAVLSPEEAFKLAGVEGGFFELQPKEGLALVNGTAVGSGMASMVLFEANILAVLAEVMSAIFAEVMQGKPEFTDHLTHKLKHHPGQIEAAAIMEHILDGSAYVKAAQKLHEMDPLQKPKQDRYALRTSPQWLGPQIEVIRSSTKMIEREINSVNDNPLIDVSRNKAIHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTSEAVEILKLMSTTFLVGLCQAIDLRHLEENLKNTVKNTVSQVAKRVLTTGVNGELHPSRFCEKDLLRVVDREYIFAYIDDPCSATYPLMQKLRQTLVEHALKNGDSERNLSTSIFQKIATFEDELKALLPKEVESARTALESGNPAIPNRIKECRSYPLYKFVREELGTEYLTGEKVRSPGEEFDKVFTAMSKGEIIDPLLECLHSWNGAPLPIC

SEQ ID NO: 104 - protein, 711 aa, Tulipa fosteriana
  MISC_FEATURE (1)..(711): Phenylalanine ammonia lyase
MEQNGNGVANGNGFCTHAEADPLNWGAAAEQLSGSHLDEVRRMVAEFRRPVVKMEGASLKISQVAAVAMAGREVRVELAEAARGRVKASSEWVMNSMSMGTDSYGVTTGFGATSHRRTKQGGALQKELIRFLNAGIFGSGRESGHTLPPSTTRAAMLVRINTLLQGYSGIRFEIMEAITSLLNTNITPCLPLRGTITASGDLVPLSYIAGILTGRPNSKAVGPDGKTIDAAEAFRLAGLDGFFELQPKEGLALVNGTAVGSGLASIVLFETNVLAVLSEVLSAVFCEVMQGKPEYTDHLTHKLKHHPGQIEAAAIMEHILDGSSYMKVAKKLHDLDPLQKPKQDRYALRTSPQWLGPQIEVIRSSTKSIEREINSVNDNPLIDVSRNKAIHGGNFQGTPIGVSMDNTRLAIAAIGKLMFAQFSELVNDFYNNGLPSNLSGGRDPSLDYGFKGAEIAMAAYCSELQFLGNPVTNHVQSAEQHNQDVNSLGLISSRKTAEAVEIMKLMCSTYLVALCQAIDLRHLEENLKSAAANTVKQVAKKVLTTGANGELHPSRFCEYNLIKVVEREYVFAYADDPCSSNYPLMQKLRGVLVEHAMGNGEKEKDVSSSIFQKIGAFEEELRAVLPKEVEAARAAVERGSPAIGNRIEECRSYPLYKFVREEVAAGFLSGEKVRSPGEEFDKVFNAICRGQLIDPMLECLKEWNGAPLPIS

SEQ ID NO: 105 - protein, 720 aa, Pyrus x bretschneideri
  MISC_FEATURE (1)..(720): Phenylalanine ammonia lyase
MEAETITQNGKNGHHQNGAVESPLCIKKDPLNWGLAADSLKGSHLDEVKRMVAEYRKPVVKLGGESLTISQVAAIATHDTGVKVELSESARAGVKASSDWVMDSMGKGTDSYGVTTGFGATSHRRTKQGAALQKELIRFLNAGVFGSATESGHTLPHQATRAAMLVRINTLLQGYSGIRFEILEAITKFLNNNVTPCLPLRGTITASGDLVPLSYIAGLLTGRPNSKAVGPNGQTLNASEAFELVGINSGFFELQPKEGLALVNGTAVGSGLASTVLFETNILALLAEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQSIDLRHLEENLRNTVKNTVSQVAKRTLTTGVNGELHPSRFCEKDLLKVVDREYVFAYIDDPCSATYPLMQKLRQVLVEHALTNGESEKNASTSIFQKIGAFEEELKTLLPKEVESARSAIESGNAAVPNRIAECRSYPLYKFVREELGGEYLTGEKVRSPGEECDRVFQAICQGKIIDPILGCLEGWNGAPLPIC

SEQ ID NO: 106 - protein, 717 aa, Prunus persica
  MISC_FEATURE (1)..(717): Phenylalanine ammonia lyase
MATNSIKQNGHQNRSLESSELCIKKDPLNWGVAAETLKGSHLDEVKRMVAEYRKPVVKLGGESLTISQVAAIATHDSGVKVELSESARAGVKASSDWVMDSMSKGTDSYGVTTGFGATSHRRTKQGAALQKELIRFLNAGVFGSTKESGHTLPHQATRAAMLVRINTLLQGYSGIRFEILEVITKFLNNNVTPCLPLRGTITASGDLVPLSYIAGMLTGRPNSKAVGPDGQTLSAAEAFEFVGINSGFFELQPKEGLALVNGTAVGSGLASTVLFDTNILALLSEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLRNTVKNTVSQVAKRTLTTGVNGELHPSRFCEKDLLKVVDREYVFAYIDDPCNATYPLMQKLRQVLVEHALTNGENEKNASTSIFQKIVAFEEELKVLLPKEVDSARAALDSGTAGVPNRITECRSYPLYKFVREELGAEYLTGEEVRSPGEECDKVFSAICEGKIIDPILDCLEGWNGAPLPIC

SEQ ID NO: 107 - protein, 711 aa, Tulipa fosteriana
  MISC_FEATURE (1)..(711): Phenylalanine ammonia lyase
MEQNGNGVANGNGFCTHAEADPLNWGAAAEQLSGSHLDEVRRMVAEFRRPVVKMEGASLKISQVAAVAMAGREVMELAEAARAGVAASSQWVMDSMSKGTDSYGVTTGFGATSHRRTKQGGALQKELIRFLNAGIFGSGAEAGHTLPATTTRAAMLVRVNTLLQGYSGIRFEILEAISSLLNHNVTPCLPLRGTITASGDLVPLSYIAGMLTGRPNSKAIGPDGTYVDAAEAFRLAGISGGFFELQPKEGLAMVNGTAVGSGLASMVLFEANILAVLAEVLSAVFCEVMQGKPEFTDHLTHKLKHHPGQIEAAAIMEHILDGSSYMKMAAKIHEMDPLQKPKQDRYALRTSPQWLGPQVEVIRTSTKSIEREINSVNDNPLIDVSRNKAIHGGNFQGTPIGVSMDNTRLAIAAIGKLMFAQISELVNDFYNNGLPSNLSGGRNPSLDYGFKGAEIAMASYCSELQFLANPVTNHVQSAEQHNQDVNSLGLISSRKTAEAVEILKLMTSTYLVALCQAVDLRHLEENLKAAVKNTVSQVAKRVLTMGVNGELHPSRFCEKDLIKMIDREYVFAYADDPCSATYPLMQKLRGVLVEHALVNGEKEKEVGTSIFHKIAAFEEELKLALPKEVEGVRVAFENGTTTIANRIKECRSYPLYRFVREELGAGYLTGEKVRSPGEEFDKVFTALNQWKVIDPLMECLSDWNGAPIPIC

SEQ ID NO: 108 - protein, 720 aa, Malus domestica
  MISC_FEATURE (1)..(720): Phenylalanine ammonia lyase
  MISC_FEATURE (197)..(197): Xaa = any amino acid
MEAETITQNGKKGHHQNGAVESPLCIKKDPLNWGLAADSLKGSHLDEVKRMVAEYRKPVVKLGGESLTISQVAAIATHDTGVKVELSESARAGVKASSDWVMDSMGKGTDSYGVTTGFGATSHRRTKQGAALQKELIRFLNAGVFGSATESGHTLPHQATRAAMLVRINTLLQGYSGIRFEILEAITKFLNSNVTPXLPLRGTITASGDLVPLSYIAGLLTGRPNSKAVGPNGQTLNASEAFELVGIDSGFFELQPKEGLALVNGTAVGSGLASTVLFETNILALLAEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQSVDLRHLEENLRNTVKNTVSQVAKRTLTTGVNGELHPSRFCEKDLLKVVDREYVFAYIDDPCSATYPLMQKLRQVLVEHALTNGESEKNASTSIFQKIGAFEEELKALLPKEVESARSAIESGNAAVPNRIAECRSYPLYKFVREELGGEYLTGEKVRSPGEECDKVFQAICQGKIIDPILGCLEGWNGAPLPIC

SEQ ID NO: 109 - protein, 719 aa, Pyrus x bretschneideri
  MISC_FEATURE (1)..(719): Phenylalanine ammonia lyase
MEAKTITQNGQNGHQNRVSESPLCIKKDPLNWGLVADSLKGSHLDEVKRMVAEYRKPVVKLGGESLTISQVAAIATHDTGVKVELSESARAGVKASSDWVMDSMGKGTDSYGVTTGFGATSHRRTNKGAALQKELIRFLNAGVFGSATESGHTLPHQATRAAMLVRINTLLQGYSGIRFEILEAITKFLNNNVTPCLPLRGTITASGDLVPLSYIAGLLTGRPNSKAVGPNGQTLSASEAFELVGINCGFFELQPKEGLALVNGTAVGSGLASTVLFETNILALLAEILSAIFAEVMQGKPEFTDHLTHKLKHHPGQIEAAAIMEHILDGSSYVKAAKKLHEQDPLQKPKQDRYALRTSPQWLGPQIEVIRFSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQSIDLRHLEENLRNTVKNTVSQVAKRTLTTGVNGELHPSRFCEKDLLKVVDREYVFAYIDDPCSATYPLMQKLREVLVEHALTNGESEKNASTSIFQKIGAFEEELKALLPKEVESARSAIESGNAAVPNRIAECRSYPLYKFVREELGGEYLTGEKVRSPGEECDKVFQAICQGKIIDPILGCLEGWNGAPLPIC

SEQ ID NO: 110 - protein, 720 aa, Malus domestica
  MISC_FEATURE (1)..(720): Phenylalanine ammonia lyase
  MISC_FEATURE (602)..(602): Xaa = any amino acid
MEAKTITQNGQNGHHQNGVSESQLCIKKDPLNWGLVADSLKGSHLDEVKRMVAEYRKPVVKLGGESLTISQVAAIATHDTGVKVELSESARAGVKASSDWVMDSMGKGTDSYGVTTGFGATSHRRTNKGAALQKELIRFLNAGVFGSATESGHTLPHQATRAAMLVRINTLLQGYSGIRFEILEAITKFLNNNVTPCLPLRGTITASGDLVPLSYIAGLLTGRPNSKAVGPNGQTLNASEAFELVGINSGFFELQPKEGLALVNGTAVGSGLASTVLFETNILALLAEILSAIFAEVMQGKPEFTDHLTHKLKHHPGQIEAAAIMEHILDGSSYVKAAKKLHEQDPLQKPKQDRYALRTSPQWLGPQIEVIRFSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQSIDLRHLEENLRNTVKNTVSQVAKRTLTTGVNGELHPSRFCEKDLLKVVDREYVFAYIDDPCSATYPLMQKLREVLXEHALTNGESEKNASTSIFQKIGAFEEELKALLPKEVESARSAIESGNAAVPNRIAECRSYPLYKFVREELGGEYLTGEKVRSPGEECDKVFQAICQGKIIDPILGCLEGWNGAPLPIC

SEQ ID NO: 111 - protein, 712 aa, Glycine max
  MISC_FEATURE (1)..(712): Phenylalanine ammonia lyase
MEATNGHQNGSFCLSSTKGSDPLNWGAAAEAMKGSHLDEVKRMVSEYRKPVVRLGGETLTIAQVAAVAGHDHGVTVELSESAREGVKASSEWVMNSMNNGTDSYGVTTGFGATSHRRTKQGGALQKELIRFLNAGIFGNGTESSHTLPHTATRAAMLVRINTLLQGYSGIRFEILEAITKLLNNNVTPCLPLRGTITASGDLVPLSYIAGLLTGRPNSKAVGPNGEVLNAKEAFELASINSEFFELQPKEGLALVNGTAVGSGLASMVLFEANILAVLSEVLSAIFAEVMQGKPEFTDHLTHKLKHHPGQIEAAAIMEHILDGSSYMKAAKKLHEIDPLQKPKQDRYALRTSPQWLGPLIEVIRFSTKSIEREINSVNDNPLIDVSRNKALHGGNFQGTPIGVSMDNTRLALASIGKLMFAQFSELVNDFYNNGLPSNLTASRNPSLDYGFKGAEIAMASYCSELQYLANPVTSHVQSAEQHNQDVNSLGLISSRKTNEAIEILKLMSSTFLIALCQAIDLRHLEENLKNSVKNTVSQVSKRILTTGVNGELHPSRFCEKDLLKVVDREYVFSYIDDPCSATYPLMQKLRQVLVDHALVNAENEKDMNTSIFQKIANFEEELKNFLPKEVESARVAYESGKAAIPNKIQECRSYPLYKFVREELGTGLLTGEKVRSPGEEFDKLFTAMCQGKIIDPLLECLGEWNGAPLPIC

SEQ ID NO: 112 - protein, 713 aa, Glycine max
  MISC_FEATURE (1)..(713): Phenylalanine ammonia lyase
MEATNGHQNGSFCLSTAKGSSDPLNWGAAAEAMKGSHLDEVKRMVAEYRKPVVRLGGETLTIAQVAAVAGHDHGVAVELSESAREGVKASSEWVMNSMNNGTDSYGVTTGFGATSHRRTKQGGALQKELIRFLNAGIFGNGTESSHTLPHTATRAAMLVRINTLLQGYSGIRFEILEAITKLLNNNVTPCLPLRGTITASGDLVPLSYIAGLLTGRPNSKAVGPSGEVLNAKEAFELASINSEFFELQPKEGLALVNGTAVGSGLASMVLFEANILAVLSEVLSAIFAEVMQGKPEFTDHLTHKLKHHPGQIEAAAIMEHILDGSSYMKAAKKLHEIDPLQKPKQDRYALRTSPQWLGPLIEVIRFSTKSIEREINSVNDNPLIDVSRNKALHGGNFQGTPIGVSMDNTRLALASIGKLMFAQFSELVNDFYNNGLPSNLTASRNPSLDYGFKGAEIAMASYCSELQYLANPVTTHVQSAEQHNQDVNSLGLISSRKTNEAIEILKLMSSTFLIALCQAIDLRHLEENLKNSVKNTVSQVSKRILTTGVNGELHPSRFCEKDLLKVVDREYIFSYIDDPCSATYPLMQKLRQVLVDHALVNAESEKDVNSSIFQKIAIFEEELKNLLPKEVEGARAAYESGKAAIPNKIQECRSYPLYKFVREELGTGLLTGEKVRSPGEEFDKLFTAMCQGKIIDPLMECLGEWNGAPLPIS

SEQ ID NO: 113 - protein, 721 aa, Solanum lycopersicum
  MISC_FEATURE (1)..(721): Phenylalanine ammonia lyase
MASSIVQNGHVNGEAMDLCKKSINVNDPLNWEMAAESLRGSHLDEVKKMVDEFRKPIVKLGGETLTVAQVASIANVDNKSNGVKVELSESARAGVKASSDWVMDSMGKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTSGFFELQPKEGLALVNGTAVGSGMASMVLFESNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGLKGAEIAMASYCSELQFLANPVTNHVQSAEQHNQDVNSLGLISARKTAEAVDILKLMSSTYLVALCQAIDLRHLEENLRSAVKNTVSQVAKRTLTMGANGELHPARFCEKELLRVVDREYVFAYADDPCSSTYPLMQKLRQVLVDHAMKNGESEKNVNSSIFQKIVAFEDELKAALPKEVESARAVVESGNPAIPNRITECRSYPLYRLVRQELGSELLTGEKVRSPGEEIDKVFTAMCNGQIIDPLLECLKSWNGAPLPIC

SEQ ID NO: 114 - protein, 717 aa, Capsicum annuum
  MISC_FEATURE (1)..(717): Phenylalanine ammonia lyase
MASTIAQNGDIVAIDLCNKSIHDPLNWEMAAESLKGSHLDEVKKMVDEFRKPIVKLGGETLTVAQVASIANADNKTCGVKVELSESARAGVKASSDWVMDSMCKGTDSYGVTTGFGATSHRRTKNGGALQKELIRFLNAGVFGNGTGSCHTLPHSATRAAMLVRINTLLQGYSGIRFEILEAITKLINSNITPCLPLRGTITASGDLVPLSYIAGLLTGRPNAKAVGPNGEKLNAEEAFRVAGVSGGFFELQPKEGLALVNGTAVGSGMASMVLFESNILAVMSEVLSAIFAEVMNGKPEFTDHLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISSRKTAEAVDILKLMSSTYLVALCQAIDLRHLEENLKNAVKNTVSQVAKRTLTMGANGELHPARFCEKELLRVVDREYLFAYADDPCSSTYPLMQKLRQVLVDHALNNGESEKNVNSSIFQKIAAFEDELKAVLPKEVESARITLESGNPSIPNRITECRSYPLYRLVRKELGTELLTGERVRSPGEEIDKVFTAMCNGQIIDPLLECLKSWNGAPLPIC

SEQ ID NO: 115 - protein, 717 aa, Nicotiana sylvestris
  MISC_FEATURE (1)..(717): Phenylalanine ammonia lyase
MASNGHVNGGENFELCKKSSATDPLNWEMAAESLRGSHLDEVKKMVSEFRKPMVKLGGETLTVAQVAAIAVRDKSANGVKVELSEEARAGVKASSDWVMDSMNKGTDSYGVTTGFGATSHRRTKNGGALQKELIRFLNAGVFGNGTETSHTLPHSATRAAMLVRINTLLQGYSGIRFEILEAIAKLINSNITPCLPLRGTITASGDLVPLSYIAGLLTGRPNSKAVSPNGETLNAEEAFRVAGVNGGFFELQPKEGLALVNGTAVGSGMASMVLFDSNILAVMSEVLSAIFAEVMNGKPEFTDHLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNARLALASIGKLMFAQFSELVNDYYNNGLPSNLTASRNPSLDYGFKGAEIAMASYCSELQFLANPVTNHVQSAEQHNQDVNSLGLISARKTAEAVDILKLMSSTYLVALCQAIDLRHLEENLKNAVKNTVSQVAKRTLTMGANGELHPARFCEKELLRVVDREYLFAYADDPCSCNYPLMQKLRQVLVDHAMNNGESEKNVNSSIFQKIGAFEDELKAVLPKEVESARAALECGNPAIANRITECRSYPLYRFVRKELGTELLTGERVRSPGEECEKVFTAMCNGQIIDPMLECLKSWNGAPLPIC

SEQ ID NO: 116 - DNA, 1647 bp, Synechococcus sp.
  misc_feature (1)..(1647): RbcS-ictB
  sig_peptide (1)..(243): Pisum sativum RbcS signal peptide
  misc_feature (244)..(1647): ictB
atggcttctatgatttcttcttctgctgtgacaacagtgtctagggcttctaggggccagtctgctgctgtggctcctttcggcggcctcaagtctatgacaggcttccctgtgaagaaggtgaatacagatattacatctattacatctaatggcggcagggtgaagtgcatgcaggtgtggcctcctattggcaagaagaagttcgagacactctcttacctccctcctctcacaagggatatgacagtgtggcagacactcacattcgctcattaccagcctcagcagtggggccattcttctttcctccataggctcttcggctctctcagggcttggagggcttcttctcagctcctcgtgtggtctgaggctctcggcggcttcctcctcgctgtggtgtacggctctgctcctttcgtgccttcttctgctctcggcctcggcctcgctgctattgctgcttactgggctctcctctctctcacagatattgatctcaggcaggctacacctattcattggctcgtgctcctctactggggcgtggatgctctcgctacaggcctctctcctgtgagggctgctgctctcgtgggcctcgctaagctcacactctacctcctcgtgttcgctctcgctgctagggtgctcaggaatcctaggctcaggtctctcctcttctctgtggtggtgattacatctctcttcgtgtctgtgtacggcctcaaccaatggatttacggcgtggaggagctcgctacatgggtggataggaattctgtggctgatttcacatctagggtgtactcttacctcggcaatcctaatctcctcgctgcttacctcgtgcctacaacagctttctctgctgctgctattggcgtgtggaggggctggctccctaagctcctcgctattgctgctacaggcgcttcttctctctgcctcattctcacatactctaggggcggctggctcggcttcgtggctatgattttcgtgtgggctctcctcggcctctactggttccagcctaggctccctgctccttggaggaggtggctcttccctgtggtgctcggcggcctcgtggctgtgctcctcgtggctgtgctcggcctcgagcctctcagggtgagggtgctctctattttcgtgggcagggaggattcttctaataatttcaggattaatgtgtggctcgctgtgctccagatgattcaggataggccttggctcggcattggccctggcaatacagctttcaatctcgtgtaccctctctaccagcaggctaggttcacagctctctctgcttactctgtgcctctcgaggtggctgtggagggcggcctcctcggcctcacagctttcgcttggctcctcctcgtgacagctgtgacagctgtgcgccaggtgtctaggctcaggagggataggaatcctcaggctttctggctcatggcttctctcgctggcctcgctggcatgctcggccatggcctcttcgatacagtgctctacaggcctgaggcttctacactctggtggctctgcattggcgctattgcttctttctggcagcctcagccttctaagcagctccctcctgaggctgagcattctgatgagaagatgtga

SEQ ID NO: 117 - protein, 548 aa, Synechococcus sp.
  MISC_FEATURE (1)..(548): RbcS-ictB
  SIGNAL (1)..(81): Pisum sativum RbcS signal peptide
  MISC_FEATURE (82)..(548): ictB
MASMISSSAVTTVSRASRGQSAAVAPFGGLKSMTGFPVKKVNTDITSITSNGGRVKCMQVWPPIGKKKFETLSYLPPLTRDMTVWQTLTFAHYQPQQWGHSSFLHRLFGSLRAWRASSQLLVWSEALGGFLLAVVYGSAPFVPSSALGLGLAAIAAYWALLSLTDIDLRQATPIHWLVLLYWGVDALATGLSPVRAAALVGLAKLTLYLLVFALAARVLRNPRLRSLLFSVVVITSLFVSVYGLNQWIYGVEELATWVDRNSVADFTSRVYSYLGNPNLLAAYLVPTTAFSAAAIGVWRGWLPKLLAIAATGASSLCLILTYSRGGWLGFVAMIFVWALLGLYWFQPRLPAPWRRWLFPVVLGGLVAVLLVAVLGLEPLRVRVLSIFVGREDSSNNFRINVWLAVLQMIQDRPWLGIGPGNTAFNLVYPLYQQARFTALSAYSVPLEVAVEGGLLGLTAFAWLLLVTAVTAVRQVSRLRRDRNPQAFWLMASLAGLAGMLGHGLFDTVLYRPEASTLWWLCIGAIASFWQPQPSKQLPPEAEHSDEKM

SEQ ID NO: 118 - DNA, 1416 bp, Oryza sativa
  promoter (1)..(1416): LOC_Os01g45274 promoter and 5'UTR
atcttggctatttcccatggcttctccgctctactcttgtccctgtttggatgacgccgtccagaccaagacatcaaaacggggcgacactgtgaggttacggtgtcgccattcgccacaatgagctcaccatgtcaccttgtcgacatttcgccgcatacaagtcgctgtgcgaccgccaggtgggccccactgtgagcagcacgagtgtggcgcgtatataaatttgtcggatggagaggcagctgaaggtttttcgccatggcaactgcgtccttcgacatctgcgcgaaggttgggctcggaatttcgacaggatactcacagcgaaatcaatactctgctatggcaaatggtacgcactcgtttcgattgttctgccttcttctgttttattttttttcccgtatgtagctgtagctgctgataaacgtgccatgtattccatctcgttcttgcaagcagtttcttagatgagttaaaatatgtattccatgtcaactgttcactttagttaggtagaactttcttacattatgattagttatctacttactctctctgtccgataataattatcgcattgattttttttataatgtttgatcattcgtcttattaaaaaaaattatagaattattttttttattttgtttgtgacttgctttattatcaaaaaaataatttaaatatggcatatctttttttatatttacaataatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgagacagtcggcacgcgggggcgcgggcgtctatttgttgcgcgcgcgggcgcggcggcgagacgcgtgtgtagctactgctataaggagcgcgccgtgcaccgcctctcacatcga

SEQ ID NO: 119 - DNA, 310 bp, Oryza sativa
  misc_feature (1)..(310): LOC_Os01g45274 3'UTR
atccgaccgtccgtccgttcagttcgtcagtttacgccaacgcttttgcataagtactacctgaggatatcgtccccgatcatcgatgtgaacgcgtggagtactactacgtacgtaccggatggttcgatatatgtgaatgctgtattaagtaataacaagaaatatatctcctctactttttcctgacgcggagttgtactgcctatgatgcataatttgatcgcagtgtgatcaaaagacatcagctataatgtcttaataatattattatgaagagtttacctttttactaccttttactctggta

SEQ ID NO: 120 - DNA, 1176 bp, Brachypodium distachyon
  misc_feature (1)..(1176): SBPase
atggagaccgtggccgcctccggctacgccaggggcgccgccaccaggtccccggcctgctgcgccgccatgtccttctcccagtcctacaggccgaaggccgccaggccgccgaccaccttctacggcgagtccgtgagggccaacaccgccaggaccctcccgggcaggcagtccaaggccgcctccagggccgccctcaccaccaggtgcgccatcggcgactccctcgaggagttcctcaccaaggccaccccggacaagaacctcatcaggctcctcatctgcatgggcgaggccatgaggaccatcgccttcaaggtgaggaccgcctcctgcggcggcaccgcctgcgtgaactccttcggcgacgagcagctcgccgtggacatgctcgccgacaagctcctcttcgaggccctcgagtactcccacgtgtgcaagtacgcctgctccgaggaggtgccggagctccaggacatgggcggcccggtggacggcggcttctccgtggccttcgacccgctcgacggctcctccatcgtggacaccaacttcaccgtgggcaccatcttcggcgtgtggccgggcgacaagctcaccggcgtgaccggcggcgaccaggtggccgccgccatgggcatctacggcccgaggaccaccttcgtggtggccctcaaggactgcccgggcacccacgagttcctcctcctcgacgagggcaagtggcagcacgtgaaggacaccaccaccatcggcgagggcaagatgttctccccgggcaacctcagggccaccttcgacaacccggactacgacaagctcgtgaactactacgtgaaggagaagtacaccctcaggtacaccggcggcatggtgccggacgtgaaccagatcatcgtgaaggagaagggcatcttcaccaacgtgacctccccgaccgccaaggccaagctcaggctcctcttcgaggtggccccgctcggcttcctcatcgagaaggccggcggccactcctccgacggcaagcagtccgtgctcgacaaggtgatcaccgtgctcgacgagaggacccaggtggcctacggctccaagaacgagatcatcaggttcgaggagaccctctacggctcctccaggctcgccgccggcgccaccgtgggcgccaccgtgtga

SEQ ID NO: 121 - protein, 391 aa, Brachypodium distachyon
  MISC_FEATURE (1)..(391): SBPase
METVAASGYARGAATRSPACCAAMSFSQSYRPKAARPPTTFYGESVRANTARTLPGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVITVLDERTQVAYGSKNEIIRFEETLYGSSRLAAGATVGATV

SEQ ID NO: 122 - DNA, 1814 bp, Zea mays
  promoter (1)..(1814): ZmCA promoter and 5'UTR
ccccgcccatgtcagcaggcctccgaggcttttggttgcccaaccagcccatgggctgaattcataacagtgttggcacacagtttcctcttcactcggaagcttattattatcgatcctgaaccagagactagcagagctagcatttcgacgacgcgtctcaactctcaacctccaagtccacctcgtgtacgtgctgccttgccagttgccactgggcactgctggcccagtgaccaaccatgcgttagatctgacagcaccaccgaaccatcctccccggtgatcaacaaacgacggcagccacatcttgcacccaacgtgatgatgaatgatgcctagaacttttgacaacaaaacgcagcacaggtagcaggtttaattcaacaagactttctactatatagagccacaccatagagataactaatctgtgcgcaaagccaaagtgctgacggcaactgtggtgcagccttttcatctccgtttttaagttttttgcccctccttttgttttctgtttttctgggaactctttaaaccgccgtggcgccgtgtaaactttgctgtagccttttcgcgtgcaatggcagagcgccctgttcttttcctgctaaagaaaaaaaaaaaggagcacctgatcgctggcaggcccacggcccacccaactgtgtctgtaacgctcggcgtccctgcattgcatgccaagtgccaaccaccagtccatagcagggtcagggagaccgcagatgaggccggggcaacggtgatgccgcaaagaggattcagaatcctttttcttttcttttcttttaccaccgggctggcatcacagattacacgcgcagtagagtaagcacgtctctctcgtagccaagaacaacagtctacacagctcgctttctccgcccttgtctgggcgttacggcaggcaagccccctcgttttcttctgctcgcgttctccttccatgtccacatctcctgtgccaccgcacgcaaggtgccaacgctccctcgccgcagtagcatcgcgtccacacaaactgcacctccactagatacggcggtgatccggcgagagagcgcgacacgcacaggccagctagcgtttctccgacgccgcgcgtttcatcatttcccgcttcccctgcccccggccgcgcgcgcgcgcccgtgtggtccagaccaggacgcgcgcggatgtgcatccggcgcgcgcccgtcggccacacggtgccgccgcgcgttatcccgagccctgtcctgtcctgtcctgttccatctcgcgcgcgagggggggaggggagggcagcgagtggcgcgctggcggatgaggcgccgagtggcccgcatccaccggcgcaggcgagccgcacgacgccgccgcgctcgcggaacgccgccgccacacatgcgcacccccggcccgcggggctgtaacggccttgtcgccacgcgtgcgccccgtgtgtataaggaggcagcgcgtacagggggcgacaacgataagcggcactcgcacgatcaatctacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaa

SEQ ID NO: 123 - DNA, 1086 bp, Zea mays
  misc_feature (1)..(1086): bZIP transcription factor
atgggctccaacgatccaaacacaccgtccaaggcctccaaggcgagcgagcaggatcagccaccggcgacaaccacctccagcgggaccgccagcgtgtacccagagtggccgtcctttcaagcgtattccgccattccaccgcacgcctttttcccaccgaccgtcgcggccaacccgcaggcgcatccgtacatgtggggcgcccaaccaatcgtcccgccatatgggaccccaccaccgccgccatatgtcatgtacccgccggggaccgtctatgcgcacccgtccacaccaccagcgatgcacccatttgggcactatccgatgccgacaaatggccatgccgaaacacacggggccgccccgagcgcgccagaaatgaacggcaaatccgagccaggccgcacaagcgccccaagcgcgaacggcattaccagccactccgaatccggcagcgaaagcgaatccgaaggctccgatgacaattcccaaaatgattcccactccaaggataacgacgggaaggaagacgggaattcccaaaacgggatgagctattccggctcccagggggtcgtgaatcagaccatggcgatgctcccgatgcagccaggggcgatggtcgggggggtgccgagctccacagccgccaatctgaatatcggggtggactactgggccgcgccggggtccgccgcggtcccggcggcgcacgggaaggccccagcggggagcgcgaggggcgaccagtgggatgagcgcgagctcaaaaaacagaaaaggaaacaatccaatcgcgaaagcgcgcgcaggtcccgcctcaggaagcaggccgagtgtgaggaactggggcagcgcgccgaagcgctgcgcagcgaaaactccagcctgcgcgccgagctcgagcgcatcaggaaagaatacgagcagctcctctcccagaatgcgtccctcaaagagaagctgggggcggcgagctccgacagcctgccagacatgaatgaacaaaatgatggcgacggcgatgggggctacaggaaacaaccggattccgacggccaccaaccgggcagcgaatcctga

SEQ ID NO: 124 - protein, 361 aa, Zea mays
  MISC_FEATURE (1)..(361): bZIP transcription factor
MGSNDPNTPSKASKASEQDQPPATTTSSGTASVYPEWPSFQAYSAIPPHAFFPPTVAANPQAHPYMWGAQPIVPPYGTPPPPPYVMYPPGTVYAHPSTPPAMHPFGHYPMPTNGHAETHGAAPSAPEMNGKSEPGRTSAPSANGITSHSESGSESESEGSDDNSQNDSHSKDNDGKEDGNSQNGMSYSGSQGVVNQTMAMLPMQPGAMVGGVPSSTAANLNIGVDYWAAPGSAAVPAAHGKAPAGSARGDQWDERELKKQKRKQSNRESARRSRLRKQAECEELGQRAEALRSENSSLRAELERIRKEYEQLLSQNASLKEKLGAASSDSLPDMNEQNDGDGDGGYRKQPDSDGHQPGSES

SEQ ID NO: 125 - DNA, 912 bp, Zea mays
  promoter (1)..(912): ZmRbcS promoter
gagctccctttaatctggcgctagatctgcatccgcggcttgcaaagataaatggcacatttagtgtgttattttgcaatacctttcatagtagatatccttaaatgcagttttaggcatgtttgggtaattaaataacatttttaggaggagttttagatttacctttctttcgtgatgactgatgacagacgtggggaattcaaatgcaactctagcgaaagttcatatatttttcataaatagctgaggctggggtaattattttttttgtagaaaaatagaataggtggaatggttggggaaggcgtaggcgctcgtggacgacgcccgataaaagacaagaggcggaattgccatgaattcgaggtagctaagtaaggcgcatatatatgccaaaaaattctactgtcactttccaatttcaatgcgctgccaaacaagccatcctggaaactgacttgaattcagcccaattctgtagatccaaacagggccggcgtcagtgcctcaggtgagagagcagcagacgatgcaaagagccaaaactgcaagcagacgcagccgaagccgaagccgaagcccaagcccaaaactgttttgtctttgcccagaaccgcgacgagcctaaactgcgcttcctcctatctacaagtccctggcacatcacgcatagtccaaccatggcgcgcaggcgataaggcgcgccacggggacgcgacatgtggtggcggacgcgatcaggatagggccaggctggccgggcgcggccacgggagaacggtggccactcgtcccacatccgcttcgtcctgtcctgtactgcgtcctgcccccaacgagagccggagccggccatcccgtcgcacactctccccctctatatatgccgtcggtgtgggggagcctact

SEQ ID NO: 126 - DNA, 1404 bp, Synechococcus sp.
  misc_feature (1)..(1404): ictB
atgacagtgtggcagacactcacattcgctcattaccagcctcagcagtggggccattcttctttcctccataggctcttcggctctctcagggcttggagggcttcttctcagctcctcgtgtggtctgaggctctcggcggcttcctcctcgctgtggtgtacggctctgctcctttcgtgccttcttctgctctcggcctcggcctcgctgctattgctgcttactgggctctcctctctctcacagatattgatctcaggcaggctacacctattcattggctcgtgctcctctactggggcgtggatgctctcgctacaggcctctctcctgtgagggctgctgctctcgtgggcctcgctaagctcacactctacctcctcgtgttcgctctcgctgctagggtgctcaggaatcctaggctcaggtctctcctcttctctgtggtggtgattacatctctcttcgtgtctgtgtacggcctcaatcagtggatttacggcgtggaggagctcgctacatgggtggataggaattctgtggctgatttcacatctagggtgtactcttacctcggcaatcctaatctcctcgctgcttacctcgtgcctacaacagctttctctgctgctgctattggcgtgtggaggggctggctccctaagctcctcgctattgctgctacaggcgcttcttctctctgcctcattctcacatactctaggggcggctggctcggcttcgtggctatgattttcgtgtgggctctcctcggcctctactggttccagcctaggctccctgctccttggaggaggtggctcttccctgtggtgctcggcggcctcgtggctgtgctcctcgtggctgtgctcggcctcgagcctctcagggtgagggtgctctctattttcgtgggcagggaggattcttctaataatttcaggattaatgtgtggctcgctgtgctccagatgattcaggataggccttggctcggcattggccctggcaatacagctttcaatctcgtgtaccctctctaccagcaggctaggttcacagctctctctgcttactctgtgcctctcgaggtggctgtggagggcggcctcctcggcctcacagctttcgcttggctcctcctcgtgacagctgtgacagctgtgcgccaggtgtctaggctcaggagggataggaatcctcaggctttctggctcatggcttctctcgctggcctcgctggcatgctcggccatggcctcttcgatacagtgctctacaggcctgaggcttctacactctggtggctctgcattggcgctattgcttctttctggcagcctcagccttctaagcagctccctcctgaggctgagcattctgatgagaagatgtga

SEQ ID NO: 127 - protein, 467 aa, Synechococcus sp.
  MISC_FEATURE (1)..(467): ictB
MTVWQTLTFAHYQPQQWGHSSFLHRLFGSLRAWRASSQLLVWSEALGGFLLAVVYGSAPFVPSSALGLGLAAIAAYWALLSLTDIDLRQATPIHWLVLLYWGVDALATGLSPVRAAALVGLAKLTLYLLVFALAARVLRNPRLRSLLFSVVVITSLFVSVYGLNQWIYGVEELATWVDRNSVADFTSRVYSYLGNPNLLAAYLVPTTAFSAAAIGVWRGWLPKLLAIAATGASSLCLILTYSRGGWLGFVAMIFVWALLGLYWFQPRLPAPWRRWLFPVVLGGLVAVLLVAVLGLEPLRVRVLSIFVGREDSSNNFRINVWLAVLQMIQDRPWLGIGPGNTAFNLVYPLYQQARFTALSAYSVPLEVAVEGGLLGLTAFAWLLLVTAVTAVRQVSRLRRDRNPQAFWLMASLAGLAGMLGHGLFDTVLYRPEASTLWWLCIGAIASFWQPQPSKQLPPEAEHSDEKM

We claim:

1. A method for increasing crop yield comprising transforming a plant with at least one phenylalanine ammonia lyase (PAL) protein-encoding sequence that encodes a protein having at least 95% identity with SEQ ID NO: 2, wherein the PAL protein-encoding sequence is expressed from a promoter selected from the group consisting of SEQ ID Nos: 3 and 5, and wherein the PAL protein-encoding sequence encodes a PAL protein having PAL enzyme activity.

2. A plant having stably incorporated into its genome a phenylalanine ammonia lyase (PAL) protein-encoding sequence that encodes a protein having at least 95% identity with SEQ ID NO: 2, wherein the PAL protein-encoding sequence is expressed from a promoter selected from the group consisting of SEQ ID Nos: 3 and 5, and wherein the PAL protein-encoding sequence encodes a PAL protein having PAL enzyme activity.

3. A seed of the plant of claim 2, wherein said seed comprises said PAL protein-encoding sequence expressed from a promoter selected from the group consisting of SEQ ID NO: 3 and 5.

4. The plant of claim 2 wherein said plant is a monocot.

5. The plant of claim 2 wherein said plant is a dicot.

6. A DNA construct comprising, in operable linkage,
   a. A promoter selected from the group consisting of SEQ ID Nos: 3 and 5, and
   b. A nucleic acid sequence encoding a PAL protein-encoding sequence that encodes a protein having at least 95% identity with SEQ ID NO: 2.

7. The method of claim 1, wherein the at least one PAL protein-encoding sequence has at least 95% identity with SEQ ID NO: 1.

8. The plant of claim 2, wherein the PAL protein-encoding sequence has at least 95% identity with SEQ ID NO: 1.

9. The DNA construct of claim 6, wherein the PAL protein-encoding sequence has at least 95% identity with SEQ ID NO: 1.

* * * * *